US012723105B2

(12) United States Patent
Liang

(10) Patent No.: US 12,723,105 B2
(45) Date of Patent: Sep. 1, 2026

(54) MONOSPECIFIC AND MULTI-SPECIFIC ANTIBODIES

(71) Applicant: BEIJING STARMAB BIOMED TECHNOLOGY LTD, Beijing (CN)

(72) Inventor: Yanbin Liang, Irvine, CA (US)

(73) Assignee: BEIJING STARMAB BIOMED TECHNOLOGY LTD, Beijing (CN)

( * ) Notice: Subject to any disclaimer, the term of this patent is extended or adjusted under 35 U.S.C. 154(b) by 916 days.

(21) Appl. No.: 17/763,582

(22) PCT Filed: Sep. 28, 2020

(86) PCT No.: PCT/US2020/053064

§ 371 (c)(1),
(2) Date: Mar. 24, 2022

(87) PCT Pub. No.: WO2021/062361

PCT Pub. Date: Apr. 1, 2021

(65) Prior Publication Data

US 2023/0340157 A1 Oct. 26, 2023

Related U.S. Application Data

(60) Provisional application No. 62/907,275, filed on Sep. 27, 2019, provisional application No. 62/989,327, filed on Mar. 13, 2020.

(51) Int. Cl.

| | |
|---|---|
| ***A61P 35/00*** | (2006.01) |
| ***A61P 25/28*** | (2006.01) |
| ***A61P 27/02*** | (2006.01) |
| ***C07K 16/46*** | (2006.01) |

(52) U.S. Cl.

CPC ............ *C07K 16/468* (2013.01); *A61P 25/28* (2018.01); *A61P 27/02* (2018.01); *A61P 35/00* (2018.01); *C07K 2317/31* (2013.01); *C07K 2317/569* (2013.01); *C07K 2317/622* (2013.01)

(58) Field of Classification Search

CPC ............ C07K 2317/22; C07K 2317/31; C07K 16/468; C07K 2317/569; A61P 35/00

USPC ...................................................... 424/136.1

See application file for complete search history.

(56) References Cited

U.S. PATENT DOCUMENTS

| | | | |
|---|---|---|---|
| 4,179,337 | A | 12/1979 | Davis et al. |
| 4,301,144 | A | 11/1981 | Washita et al. |
| 4,485,045 | A | 11/1984 | Regen |
| 4,496,689 | A | 1/1985 | Mitra |
| 4,544,545 | A | 10/1985 | Ryan |
| 4,560,655 | A | 12/1985 | Baker |
| 4,640,835 | A | 2/1987 | Shimizu et al. |
| 4,657,866 | A | 4/1987 | Kumar |
| 4,670,417 | A | 6/1987 | Washita et al. |
| 4,767,704 | A | 8/1988 | Cleveland et al. |
| 4,791,192 | A | 12/1988 | Nakagawa et al. |
| 4,927,762 | A | 5/1990 | Darfler |
| 5,013,556 | A | 5/1991 | Woodle et al. |
| 5,122,469 | A | 6/1992 | Mather et al. |
| 5,204,244 | A | 4/1993 | Fell et al. |
| 5,534,615 | A | 7/1996 | Baker et al. |
| 6,797,492 | B2 | 9/2004 | Daugherty et al. |
| 7,117,096 | B2 | 10/2006 | Luo et al. |
| 8,217,149 | B2 | 7/2012 | Irving et al. |
| 8,502,014 | B2 | 8/2013 | Grosveld |
| 8,507,748 | B2 | 8/2013 | Grosveld |
| 8,883,150 | B2 | 11/2014 | Craig et al. |
| 8,921,522 | B2 | 12/2014 | Grosveld et al. |
| 8,921,524 | B2 | 12/2014 | Grosveld et al. |
| 2009/0307787 | A1 | 12/2009 | Grosveld et al. |
| 2011/0118444 | A1 | 5/2011 | Grosveld et al. |
| 2011/0209230 | A1 | 8/2011 | Korman et al. |
| 2013/0323235 | A1 | 12/2013 | Craig et al. |
| 2013/0344057 | A1 | 12/2013 | Grosveld et al. |
| 2014/0033335 | A1 | 1/2014 | Grosveld |
| 2014/0037616 | A1 | 2/2014 | Grosveld |
| 2014/0037631 | A1 | 2/2014 | Baty et al. |
| 2014/0356908 | A1 | 12/2014 | Grosveld et al. |
| 2016/0280795 | A1 | 9/2016 | Wang |
| 2017/0283510 | A1 | 10/2017 | Keyt et al. |
| 2019/0276554 | A1 | 9/2019 | Yu et al. |
| 2025/0376535 | A1* | 12/2025 | Liang ................ C07K 16/2878 |

FOREIGN PATENT DOCUMENTS

| | | | |
|---|---|---|---|
| CN | 110003335 | A | 7/2019 |
| WO | 1987/000195 | A1 | 1/1987 |
| WO | 1990/003430 | A1 | 4/1990 |
| WO | 1991/017271 | A1 | 11/1991 |
| WO | 1992/001047 | A1 | 1/1992 |
| WO | 1992/006204 | A1 | 4/1992 |
| WO | 2004/062551 | A2 | 7/2004 |
| WO | 2006/133396 | A2 | 12/2006 |
| WO | 2007/005874 | A2 | 1/2007 |
| WO | 2013/119714 | A1 | 8/2013 |
| WO | 2014/055897 | A2 | 4/2014 |
| WO | 2014/198748 | A1 | 12/2014 |
| WO | 2016/188449 | A1 | 12/2016 |

(Continued)

OTHER PUBLICATIONS

NCT06087770 _ Clinical Study of SM3321 With Solid Tumors (pp. 1-12; published Oct. 18, 2023).*

(Continued)

*Primary Examiner* — Lynn A Bristol
(74) *Attorney, Agent, or Firm* — K&L Gates LLP

(57) ABSTRACT

The invention provides monospecific and multi-specific single chain antibodies directed against one or more of the human antigens: CD47, PD-L1, HSA, CD33, LAG3, and CD16. Also provided are methods of administering a pharmaceutical composition of a multi-specific antibody with antigen-binding specificity for two different antigens and methods for treating various diseases, including Alzheimer's disease, cancer, and retinal diseases.

16 Claims, 27 Drawing Sheets

Specification includes a Sequence Listing.

(56) References Cited

FOREIGN PATENT DOCUMENTS

| | | | |
|---|---|---|---|
| WO | 2017/025033 A1 | | 2/2017 |
| WO | 2019/068302 A1 | | 4/2019 |
| WO | 2019/118770 A1 | | 6/2019 |
| WO | 2019/157843 A1 | | 8/2019 |
| WO | 2021/062361 A2 | | 4/2021 |
| WO | 2024006831 A2 | * | 1/2024 |
| WO | 2025101526 A1 | * | 5/2025 |

OTHER PUBLICATIONS

Fujimori et al. (J. Nuc. Med. 31:1191-1198 (1990)).*
Beckman et al. (Can. 109:170-179 (2007)).*
Thurber et al. (Adv. Drug Deliv. Rev. 60:1421-1434 (2008)).*
Rudnick et al. (Can. Biotherp. & Radiopharm. 24: 155-162 (2009)).*
Huang et al. (Appl Microbiol Biotechnol (2010) 87:401-410).*
Extended European Search Report, dated Feb. 2, 2024, for European Application No. 20868232.8.
Ratnikova et al., "TUE-067: Design and development of alpacas VHHantibodies specific to CD47 protein on cancer cells," The FEBS Journal; FEBS EMBO 201 Conference, Wiley Blackwell Publishing Ltd, vol. 281. 1 Sep. 1, 2014, (Sep. 1, 2014), p. 453.
Behar et al., "Isolation and characterization of anti-Fc RIII (CD16) llama single-domain antibodies that activate natural killer cells," Protein Engineering, Design and Selection, vol. 21, Dec. 19, 2007 (Dec. 19, 2007), pp. 1-10.
Li et al., "Single domain based bispecific antibody, Muc1-Bi-1, and its humanized form, Muc1-Bi-2, induce potent cancer cell killing in muc1 positive tumor cells," PLOS ONE, vol. 13, Jan. 22, 2018 (Jan. 22, 2018), pp. 1-14.
International Search Report and Written Opinion, mailed on Mar. 15, 2021, for International Patent Application Serial No. PCT/US2020/53064 filed on Sep. 28, 2020.
Sakuishi et al., Targeting Tim-3 and PD-1 pathways to reverse T cell exhaustion and restore anti-tumor immunity. J Exp. Med., vol. 207(10), pp. 2187-2194 (2010).
Rissiek i et al., Nanobodies as modulators of inflammation: potential applications for acute brain injury. Front Cell Neurosci., vol. 8, Article 344 (2014).

* cited by examiner

| | B6H12 | A09 |
|---|---|---|
| Best-fit values | | |
| logECF | 0.7478 | -0.4402 |
| HillSlope | 0.7792 | 1.063 |
| F | = 50.00 | = 50.00 |
| Bottom | 2.834 | 13.05 |
| Top | 1579 | 1462 |
| ECF | 5.594 | 0.3629 |

| | 1511 | 3321 | B6H12 |
|---|---|---|---|
| Best-fit values | | | |
| logECF | -0.3444 | -0.5735 | -0.3016 |
| HillSlope | -0.8184 | -0.8636 | -1.192 |
| F | = 50.00 | = 50.00 | = 50.00 |
| Bottom | 0.08027 | 0.07427 | 0.05844 |
| Top | 0.4579 | 0.4979 | 0.4070 |
| ECF | 0.4525 | 0.2670 | 0.4993 |

| Best-fit values | 015-11 | 3321 |
|---|---|---|
| logECF | 0.1071 | -0.02913 |
| HillSlope | -1.127 | -1.054 |
| F | = 50.00 | = 50.00 |
| Bottom | 22.01 | 23.80 |
| Top | 62.49 | 62.45 |
| ECF | 1.280 | 0.9351 |

| | SM015-11 HL60 | SM3321 HL60 |
|---|---|---|
| logECF | 1.418 | -0.7389 |
| HillSlope | 1.232 | 1.542 |
| F | = 50.00 | = 50.00 |
| Bottom | 28.92 | 35.50 |
| Top | 548.1 | 564.9 |
| ECF | 26.19 | 0.1824 |
| Span | 519.1 | 529.4 |

| | PL14 | PL16 | Tencentriq |
|---|---|---|---|
| Best-fit values | | | |
| logECF | 0.3193 | 0.2509 | 0.1314 |
| HillSlope | 1.502 | 1.159 | 1.736 |
| F | = 50.00 | = 50.00 | = 50.00 |
| Bottom | 26.18 | 19.66 | 30.15 |
| Top | 440.2 | 441.8 | 433.0 |
| ECF | 2.086 | 1.782 | 1.353 |

| | 1511 | Atezolizumab |
|---|---|---|
| Best-fit values | | |
| logECF | -0.2238 | -0.1834 |
| HillSlope | 1.570 | 2.592 |
| F | = 50.00 | = 50.00 |
| Bottom | 19532 | 18999 |
| Top | 95535 | 93272 |
| ECF | 0.5973 | 0.6555 |

| | Loading | Assay | KD (M) | kon(1/Ms) | kdis(1/s) |
|---|---|---|---|---|---|
| B | HS5 | 100nM HSA | 9.46E-10 | 8.09E+05 | 7.65E-04 |
| C | HS6 | | 4.98E-10 | 1.67E+06 | 8.29E-04 |
| D | HS12 | | 5.68E-10 | 1.03E+06 | 5.83E-04 |
| F | HS27 | | 1.14E-09 | 7.61E+05 | 8.65E-04 |
| G | CTRL ALB 2ug/ml | | 2.30E-09 | 6.78E+05 | 1.56E-03 |

| | B6H12-IgG1 | 1511 | 3321 | B6H12IgG4 |
|---|---|---|---|---|
| Best-fit values | | | | |
| logECF | -0.1186 | -1.387 | -0.5654 | ~ 1.582 |
| HillSlope | 3.181 | 0.7676 | 0.8801 | ~ 8.947 |
| F | = 50.00 | = 50.00 | = 50.00 | = 50.00 |
| Bottom | 226.6 | 94.56 | 166.5 | 219.6 |
| Top | 641.0 | 2239 | 2131 | ~ 349.5 |
| ECF | 0.7611 | 0.04097 | 0.2720 | ~ 38.16 |

| | 1518HS5GS15 | 1518HS5 |
|---|---|---|
| Best-fit values | | |
| logECF | 0.9226 | 1.415 |
| HillSlope | 0.8186 | 0.5561 |
| F | = 50.00 | = 50.00 |
| Bottom | 2.724 | 1.393 |
| Top | 110.9 | 70.47 |
| ECF | 8.367 | 26.00 |

```
A09-10     QVQLVESGGGLVQAGGSLRLSCAASGGGRTFSNYALGWFRQAPGKEREFVAAISRSGGNI 60
A09-006    QVQLVESGGGLVQAGGSLRLSCAASG--IRFFGSALGWFRQAPGKEREFVAAISRSGGNI 58
A09-004    QVQLVESGGGLVQAGGSLRLSCAASG--GVMWSSALGWFRQAPGKEREFVAAISRSGGNI 58
A09-08     QVQLVESGGGLVQAGGSLRLSCAASG--YGVNSYALGWFRQAPGKEREFVAAISRSGGNI 58
A09-31     QVQLVESGGGLVQAGGSLRLSCAASG--YGVNSYALGWFRQAPGKEREFVAAISRSGGNI 58
A09-61     QVQLVESGGGLVQAGGSLRLSCAASG--YGVNSYALGWFRQAPGKEREFVAAISRSGGNI 58
           **************************    . .  **************************

A09-10     NYADSAKGRFTISRDNFKNTTYLQMSSLKPEDTAVYYCAAHYLLLPSYISTSTNMYNYWG 120
A09-006    NYADSAKGRFTISRDNFKNTTYLQMSSLKPEDTAVYYCAAHYLLLPSYISTSTNMYNYWG 118
A09-004    NYADSAKGRFTISRDNFKNTTYLQMSSLKPEDTAVYYCAAHYLLLPSYISTSTNMYNYWG 118
A09-08     NYADSAKGRFTISRDNFKNTTYLQMSSLKPEDTAVYYCAAHYLLLPSYISTSTNMYNYWG 118
A09-31     NYADSAKGRFTISRDNFKNTTYLQMSSLKPEDTAVYYCAAHYLLLPSYIATAIKMYNYWG 118
A09-61     NYADSAKGRFTISRDNFKNTTYLQMSSLKPEDTAVYYCAAHYLLLPSYISFASKMYNYWG 118
           *************************************************: : :******

A09-10     QGTQVTVSS 129     SEQ ID NO:7
A09-006    QGTQVTVSS 127     SEQ ID NO:6
A09-004    QGTQVTVSS 127     SEQ ID NO:5
A09-08     QGTQVTVSS 127     SEQ ID NO:2
A09-31     QGTQVTVSS 127     SEQ ID NO:3
A09-61     QGTQVTVSS 127     SEQ ID NO:4
           *********
```

FIG. 21

```
PL2      QVQLVESGGGLVQAGGSLRLSCAVSGLTLSRYTMAWFRQAPGKEREFVAAIIRNSVSTFH   60
PL14     EVQLVESGGGLVQAGGSLRLSCAASGSTSGIYDMGWYRQAPGKLREVVGII-TSGGTTNY   59
hPL14    EVQLVESGGGLVQPGGSLRLSCAASGSTSGIYDMGWYRQAPGKLREVVSVI-TSGGTTYY   59
PL16     QVQLVESGGGLVQAGGSLRLSCAFSGGTFLTYSLGWFRQGPGKEREFVASINWSGYMTSY   60
hPL16    EVQLVESGGGLVQPGGSLRLSCAASGGTFLTYSMSWVRQAPGKEREFVSSINWSGYMTYY   60
PL11     QVQLVESGGGLVQAGGSLRLSCAASGRTFNTYDMGWFRRAPGKEREFVAGIDWYTTNTYY   60
PL17     QVQLVESGGGLVQAGGSLRLSCAASGRTFNTYDMGWFRRTPGKEREFVAGMDWNTINTYY   60
PL18     EVQLVESGGGLVQAGGSLRLSCAASGRTFNIYSMAWFRQAPGKEREFVVRINWNRGTTYY   60
         ;************ ********* ** *    * :.* *: *** **.*  :      * :

PL2      EESVKGRFTISRDNVKNMMYLQMNTLKPEDTAVYYCATNVGPTGGFSLQSVQRYDAWGQG   120
PL14     ADFAKGRFTISRDNAKNMMYLQMNSLKPEDTAVYYCNIRTRL------------IIWGQG   107
hPL14    ADSVKGRFTISRDNSKNTLYLQMNSLRAEDTAVYYCNIRTRL------------IIWGQG   107
PL16     VDSVKGRFTISRDNAKNTVYLQMNSLKPEDTALYYCAAARTAI---AAKRSSEFDYWGQG   117
hPL16    ADSVKGRFTISRDNSKNTLYLQMNSLRAEDTAVYYCAAARTAI---AAKRSSEFDYWGQG   117
PL11     ADSVKGRFTISRDNAKNTVYLQMRSLKPEDTAVYYCAAGIRST----ATITGQADYWGQG   116
PL17     ADSVKGRFTISRDNAKNTVYLQMRSLKPEDTAVYYCAAGIRST----AIITGQADYWGQG   116
PL18     ADSVKGRFTISRDNAKNTVYLQMSNLKPEDTAVYYCAARGSPSTIGAFTSASHYDYWGQG   120
          : .********** ** :**** .*: ****:***                    ****

PL2      TQVTVSS 127   SEQ ID NO:31
PL14     TQVTVSS 114   SEQ ID NO:33
hPL14    TLVTVSS 114   SEQ ID NO:37
PL16     AQVTVSS 124   SEQ ID NO:34
hPL16    TQVTVSS 124   SEQ ID NO:38
PL11     AQVTVSS 123   SEQ ID NO:32
PL17     TQVTVSS 123   SEQ ID NO:35
PL18     TQVTVSS 127   SEQ ID NO:36
         : *****
```

FIG. 22

```
HS10    EVQLVESGGGLVQPGGSLRLSCAASGSTDSAYRMGWFRQAPGKEREFVSAINWSDGRTYY  60
HS27    EVQLVESGGGLVQPGGSLRLSCAASGRTFSPYTMGWFRQASGKERESVAATTWTGSRSYY  60
HS12    QVQLVESGGGSVQAGGSLRLSCAASGRTFISFSMGWFRQAPGKEREFVASITNSGSGILY  60
HS2     EVQLVESGGGLVQAGGSLRLSCAASGRAFSSYAMGWFRQAPRKEREFVATISLSGGYTYY  60
HS22    EVQLVESGGGLVHAGGSLRLSCAASGPTFSNYFMGWFRQAPGKEREFVAAVKWSGYHTYY  60
HS6     EVQLVESGGGLVQAGGSLRLSCAASGRIFHTYAVGWFRQAPGKERESVVIINWSSDHTYV  60
HS5     EVQLVESGGGLVQAGGSLRLSCAASGRTFTTHAMGWFRQAPGKEREFVATINWGGRTTYY  60
        :***:***** *: ************     . :******  **** *   .  .

HS10    ADSVKGRFTISRDNSKNTLYLQMNSLRAEDTAVYYCAADPDSRLYYTVP---QNYDYWGQ  117
HS27    GESVKGRFTISRDSTKNTMSLQMNSLKPEDTAVYYCAAADGAGLYT----NRGQYDYWGQ  116
HS12    GDSVKGRFTISRDNAKNTMYLQMNSLKPEDTAVYYCAAGTGAGR----YRYASMFDYWGQ  116
HS2     ADSVKGRFTISRDNAKNTLYLQMNSLKPEDTAVYYCAAGESS-------SRQDKWYDYWGQ  114
HS22    SDSVKGQFTISRDNAKNTVYLQMNSLKPEDTAVYYCAAGGTFSNWYTRPRSGDSYDHWGQ  120
HS6     AQSVKGRFTISRDRAKNTFYLQMNSLKPEDTAVYYCAVRRRLY-----GLRESDFDSWGQ  115
HS5     ADSVKGRFIISRDTGANTVYLQMNSLKPEDTAVYYCASNLDTY-----NVRAGTTNSWGQ  115
        .:****:* ****   **. ******: *********                  : ***

HS10    GTLVTVSS 125          SEQ ID NO:47
HS27    GTQVTVSS 124          SEQ ID NO:45
HS12    GTQVTVSS 124          SEQ ID NO:43
HS2     GTQVTVSS 122          SEQ ID NO:40
HS22    GTQVTVSS 128          SEQ ID NO:44
HS6     GTQVTVSS 123          SEQ ID NO:42
HS5     GTQVTVSS 123          SEQ ID NO:41
        ** *****
```

*FIG. 23*

```
33-13   QVQLVESGGGLVQAGGSLRLSCAASGSISSINSMNWYRQAPGKQREKVAGINSSGDTN-Y   59
33-2    QVQLVESGGGLVQAGGSLRLSCTASANILRTAPMAWYRQAPGKQREFVALITADGTTD-Y   59
33-4    QVQLVESGGGSVQPGGSLRLSCEASGSIFSIAHMGWYRQAPGKQRELVAVISSGGRTN-Y   59
33-14   QVQLVESGGGLVQAGDSLKLSCAASGRTSLILAMAWWRQAPGKEREFAGRIWWNNDMTRY   60
33-24   EVQLVESGGGLVQAGGSLRLSCLASGRTSSNSAMGWFRQAPGKEREFVGAITWNGDTTLY   60
33-8    EVQLMESGGGLVQAGGSLRLSCAASGRTVSTYVMGWFRQAPGKEREFVAEINRIGDTLYN   60
33-G3   QVQLVESGGGLVQTGGSLRLSCAASGGTFTNYAMGWFREAPGKEREFVAGINNNGDTLYN   60
33-C1   QVQLVESGGGLVQTGGSLRLSCAASGGTFTNYAMGWFREAPGKEREFVAGINNNGDTLYN   60
33-F1   QVQLVESGGGLVQTGGSLRLSCAASGGTFTNYAMGWFREAPGKEREFVAGINNNGDTLYN   60
33-E3   QVQLVESGGGLVQTGGSLRLSCAASGGTFTNYAMGWFREAPGKEREFVAGINNNGDTLYN   60
33-F2   QVQLVESGGGLVQTGGSLRLSCAASGGTFTNYAMGWFREAPGKEREFVAGINNNGDTLYN   60
33-H2   QVQLVESGGGLVQTGGSLRLSCAASGGTFTNYAMGWFREAPGKEREFVAGINNNGDTLYN   60
33-B2   QVQLVESGGGLVQTGGSLRLSCAASGGTFTNYAMGWFREAPGKEREFVAGINNNGDTLYN   60
33-A1   QVQLVESGGGLVQTGGSLRLSCAASGGTFTNYAMGWFREAPGKEREFVAGINNNGDTLYN   60
33-G1   QVQLVESGGGLVQTGGSLRLSCAASGGTFTNYAMGWFREAPGKEREFVAGINNNGDTLYN   60
33-B3   QVQLVESGGGLVQTGGSLRLSCAASGGTFTNYAMGWFREAPGKEREFVAGINNNGDTLYN   60
33-D2   QVQLVESGGGLVQTGGSLRLSCAASGGTFTNYAMGWFREAPGKEREFVAGINNNGDTLYN   60
33-C3   QVQLVESGGGLVQTGGSLRLSCVASGGTFTNYAMGWFREAPGKEREFVAGINNNGDTLYN   60
33-B1   QVQLVESGGGLVQTGGSLRLSCAASGGTFTNYAMGWFREAPGKEREFVAGINNNGDTLYN   60
33-F3   QVQLVESGGGLVQTGGSLRLSCAASGGTFTNYAMGWFREAPGKEREFVAGINNNGDTLYN   60
33-D3   QVQLVESGGGLVQTGGSLRLSCAASGGTFTNYAMGWFREAPGKEREFVAGINNNGDTLYN   60
33-E2   QVQLVESGGGLVQTGGSLRLSCAASGGTFTNYAMGWFREAPGKEREFVAGINNNGDTLYN   60
33-H1   QVQLVESGGGLVQTGGSLRLSCAASGGTFTNYAMGWFREAPGKEREFVAGINNNGDTLYN   60
33-A2   QVQLVESGGGLVQTGGSLRLSCAASGGTFTNYAMGWFREAPGKEREFVAGINNNGDTLYN   60
33-1    QVQLVESGGGLVQTGGSLRLSCAASGGTFTNYAMGWFREAPGKEREFVAGINNNGDTLYN   60
33-D1   QVQLVESGGGLVQTGGSLRLSCAASGGTFTNYAMGWFREAPGKEREFVAGINNNGDTLYN   60
33-C2   QVQLVESGGGLVQTGGSLRLSCAASGGTFTNYAMGWFREAPGKEREFVAGINNNGDTLYN   60
33-G2   QVQLVESGGGLVQTGGSLRLSCAASGGTFTNYAMGWFREAPGKEREFVAGINNNGDTLYN   60
        :***:***** ** *.**:*** **.       * *:*:****:** .. *   .

33-13   VDSVKGRFTISRDNAERTTYLQMNNLKPEDTGLYYCNADPRPWP-NDVAFGSWGQGTRVT   118
33-2    QESVKGRFTTSRDNAKNTVYLQMNSLQSEDTARYFCKV-----------YSYWGQGTQVT   108
33-4    VDSVKGRFTISRDNAKNTVYLQMNSLKAEDTAVYFCNVAVVG----GPRFDYWGQGTQVT   115
33-14   SDSVKGRFTISKDNTKNMVYLRMDNLGPEDTAVYYCEADLIGGS------RGWGQGTQVT   114
33-24   AYYVKDRFTISRDNAKRMVYLQMNSLKPEDTAVYYCAATDKFASSQADSYTTWGQGTQVT   120
33-8    RTSVKGRFTISRDNAKNTVYLQMNSLEPEDTAVYSCAARVIG----TSTYNYWGQGTQVT   116
33-G3   TNSVKGRFTISRDNAKNTVYLHMNSLKLEDTAVYYCAANIKASSWYSSHYNYWGQGTQVT   120
33-C1   TNSVKGRFTISRDNAKNTVYLHMNSLKLEDTAVYYCAANLSGASWFASQYEFWGQGTQVT   120
33-F1   TNSVKGRFTISRDNAKNTVYLHMNSLKLEDTAVYYCAANVSGASWYASHYEFWGQGTQVT   120
33-E3   TNSVKGRFTISRDNAKNTVYLHMNSLKLEDTAVYYCAANISAASWYASQYDFWGQGTQVT   120
33-F2   TNSVKGRFTISRDNAKNTVYLHMNSLKLEDTAVYYCAANVSEASWFASKYDFWGQGTQVT   120
33-H2   TNSVKGRFTISRDNAKNTVYLHMNSLKLEDTAVYYCAAKVRAASWFAAQYKFWGQGTQVT   120
33-B2   TNSVKGRFTISRDNAKNTVYLHMNSLKLEDTAVYYCAANINAASWFAAKYDSWGQGTQVT   120
```

FIG. 24

```
33-A1   TNSVKGRFTISRDNAKNTVYLHMNSLKLEDTAVYYCAAKFSGASWYSAQYHSWGQGTQVT  120
33-G1   TNSVKGRFTISRDNAKNTVYLHMNSLKLEDTAVYYCAAKFRGASWFSSHYNFWGQGTQVT  120
33-B3   TNSVKGRFTISRDNAKNTVYLHMNSLKLEDTAVYYCAANVRGSSWFSSHYDFWGQGTQVT  120
33-D2   TNSVKGRFTISRDNAKNTVYLHMNSLKLEDTAVYYCAANIRGSSWFATHYDSWGQGTQVT  120
33-C3   TNSVKGRFTISRDNAKNTVYLHMNSLKLEDTAVYYCAANFKGASWFASHYQSWGQGTQVT  120
33-B1   TNSVKGRFTISRDNAKNTVYLHMNSLKLEDTAVYYCAAKLKGASWFASHYKSWGQGTQVT  120
33-F3   TNSVKGRFTISRDNAKNTVYLHMNSLKLEDTAVYYCAAKISGASWFAAHYKSWGQGTQVT  120
33-D3   TNSVKGRFTISRDNAKNTVYLHMNSLKLEDTAVYYCAANLRGASWFAANYKYWGQGTQVT  120
33-E2   TNSVKGRFTISRDNAKNTVYLHMNSLKLEDTAVYYCAAKLRGASWFAANYDSWGQGTQVT  120
33-H1   TNSVKGRFTISRDNAKNTVYLHMNSLKLEDTAVYYCAANVRGASWFAAHYNSWGQGTQVT  120
33-A2   TNSVKGRFTISRDNAKNTVYLHMNSLKLEDTAVYYCAANFNGASWFAANYHFWGQGTQVT  120
33-1    TNSVKGRFTISRDNAKNTVYLHMNSLKLEDTAVYYCAANLKGASWYSANYDYWGQGTQVT  120
33-D1   TNSVKGRFTISRDNAKNTVYLHMNSLKLEDTAVYYCAANFNGASWFSSNYEYWGQGTQVT  120
33-C2   TNSVKGRFTISRDNAKNTVYLHMNSLKLEDTAVYYCAANVKGASWFSANYQSWGQGTQVT  120
33-G2   TNSVKGRFTISRDNAKNTVYLHMNSLKLEDTAVYYCAANVKGASWFSSNYKYWGQGTQVT  120
           **.*** *:**::. .**:*:.*  ***. * * .              *****:**

33-13   VSS  121       SEQ ID NO:54
33-2    VSS  111       SEQ ID NO:51
33-4    VSS  118       SEQ ID NO:52
33-14   VSS  117       SEQ ID NO:55
33-24   VSS  123       SEQ ID NO:56
33-8    VSS  119       SEQ ID NO:53
33-G3   VSS  123       SEQ ID NO:75
33-C1   VSS  123       SEQ ID NO:62
33-F1   VSS  123       SEQ ID NO:70
33-E3   VSS  123       SEQ ID NO:69
33-F2   VSS  123       SEQ ID NO:71
33-H2   VSS  123       SEQ ID NO:77
33-B2   VSS  123       SEQ ID NO:60
33-A1   VSS  123       SEQ ID NO:57
33-G1   VSS  123       SEQ ID NO:73
33-B3   VSS  123       SEQ ID NO:61
33-D2   VSS  123       SEQ ID NO:66
33-C3   VSS  123       SEQ ID NO:64
33-B1   VSS  123       SEQ ID NO:59
33-F3   VSS  123       SEQ ID NO:72
33-D3   VSS  123       SEQ ID NO:67
33-E2   VSS  123       SEQ ID NO:68
33-H1   VSS  123       SEQ ID NO:76
33-A2   VSS  123       SEQ ID NO:58
33-1    VSS  123       SEQ ID NO:50
33-D1   VSS  123       SEQ ID NO:65
33-C2   VSS  123       SEQ ID NO:63
33-G2   VSS  123       SEQ ID NO:74
         ***
```

*FIG. 24. (cont.)*

```
LG-C4    QVQLVESGGRLVQAGGSLGLSCAASGLAFREYSMGWFRRAPGKEREFVAAVD-WTGIQYY   59
LG-E12   QVQLVESGGGLVHPGGSLNLSCVAHGFSLDSHDMGWFRQAPGKEREVVACIKHRDGRIYI   60
LG2      QVQLVESGGGLVQPGGSLRLSCAASGTIFSINAMGWYRQAPGKQRELVAIVT-FGGSTNY   59
LG6      EVQLVESGGGLVQAGGSLRLSCAVSGSIFSISTMGWYRQAPGKQRELVASIT-ARGSADY   59
LG-D8    QVQLVESGGGLVQPGGSLRLSCAASGFTFGKYAMSWVRQVPDKGLEWVSSISSSGRDTSY   60
LG15     EVQLAESGGGLVQPGGSLRLSCATSGFAFRSYVMSWVRQAPGKGLEWVSTIN-SDSRTSY   59
LG9      EVQLVESGGGLVQPGGSLRLSCAASGSTIDDYPIGWFRQAPGKEREGVSCIDDSDESTYY   60
LG99     EVQLLESGGGLVQPGGSLRLSCAASGSTIDDYPMSWFRQAPGKGREGVAAIDDSDESTYY   60
LG9H     EVQLLESGGGLVQPGGSLRLSCAASGSTIDDYPMSWFRQAPGKGREGVAAIDDSDESTYY   60
LG65     QVQLVESGGGLVQPGGSLRLSCAVSGFTSATYSIAWFRQAPGKEREGVSCISTGDGSTYY   60
LG-E5    QVQLVESGGGLVQPGGSLRLSCAHSGFTLDYYALGWFRQAPGKEREAVSCISSSDGSTYY   60
LG-H4    QVQLVESGGGLVQPGGSLRLSCAASGFSLDYYTIGWFRQAPGKEREAVSCINRSDGSTYY   60
LG19     QVQLVESGGGLVQPGGSLRLSCAASGFTLDYYAIGWFRQAPGKEREGVSCISSSDGSTYY   60
LG22     EVQLVESGGGLVQPGGSLRLSCAASGFTLDYYAIGWFRQAPGKEREGVSCIINSDGSTYY   60
         :*** **** **: **** ***.  *         :.* *:.*.*   * *: :

LG-C4    ADSVKGRATISRDTAKSTVFLQMNSLNPEDTAFYYCAAGKKLTG--IVLLTRRTEYDYWG   117
LG-E12   LEAVKDRFVISRDNAKNTVYLEMNNLSDEDTAVYHCATASSCSDNWWLLI-GDAYAGYWG   119
LG2      ADSVKGRFTISRDNAKNTVYLQMNSLKPEDTAVYYCSARNVQ-------SPVQYHLAVWG   112
LG6      ADSVKGRFTISRDNAKNTVYLQMSSLKPEDTAVYYCNTDTRS-------TLY---HYSWG   109
LG-D8    ADSAKGRFTIFRNNAANTVYLQMDNLKLEDTGVYYCVKCLE--------VWATREYDGWG   112
LG15     ADSVKGRFTISRDNAKNTLYLQMNSLKVEDTAVYYCSKQSP-------------GTSQRG   106
LG9      ADSVKGRFTISRDNAKNTVYLQMNSLKPEDTAVYYCARGAIFMIDGV-DVFLTYYYDSWG   119
LG99     ADSVKGRFTISRDNSKNTLYLQMNSLRAEDTAVYYCARGALFMIDGV-DVFLTYYFEFWG   119
LG9H     ADSVKGRFTISRDNSKNTLYLQMNSLRAEDTAVYYCARGAIFMIDGV-DVFLTYYYDSWG   119
LG65     APAVKGRFTISSDNAKNTVYLQMNGLKPEDTAVYYCAKRAGYGSAWFCPLDPSLQYDSWG   120
LG-E5    ADSVKGRFTISRDNAKNTVYLQMNSLKPEDTAVYYCASTRY-GSS--C-RGGQWDTGSWG   116
LG-H4    ADSVKGRFTISRDNAKNTVYLQMNSLKPEDTAVYYCASTTY-GTS--C-RGGQWDTGSWG   116
LG19     ADSVKGRFTISRDNAKNTVYLQMNSLKPEDTAVYYCAADRR-GS---C-R----QYDYWG   111
LG22     ADSVKGRFTISRDNAKNTVYLQMNSLKPEDTAVYYCATDRY-SD---C-RG---PYDYWG   112
           :.*.* .*  :.: .*::*:*..*  ***..*:*                     *

LG-C4    QGTQVTVSS 126        SEQ ID NO:91
LG-E12   QGTQVTVSS 128        SEQ ID NO:87
LG2      QGTLVTVSS 121        SEQ ID NO:80
LG6      QGTQVTVSS 118        SEQ ID NO:81
LG-D8    QGTQVTVSS 121        SEQ ID NO:86
LG15     QGTQVTVSS 115        SEQ ID NO:88
LG9      QGTQVTVSS 128        SEQ ID NO:82
LG99     QGTLVTVSS 128        SEQ ID NO:90
LG9H     QGTLVTVSS 128        SEQ ID NO:83
LG65     QGTQVTVSS 129        SEQ ID NO:89
LG-E5    QGTQVTVSS 125        SEQ ID NO:92
LG-H4    QGTQVTVSS 125        SEQ ID NO:93
LG19     QGTQVTVSS 120        SEQ ID NO:84
LG22     QGTQVTVSS 121        SEQ ID NO:85
         *** *****
```

*FIG. 25*

```
CD16F1   EVQLVESGGGLVQPGGSLRLSCAVSGSLFSARVMGWYRQAPGKQRELVAAIT-SGVRTDY   59
CD16E11  QVQLVESGGGLVQPGGSLTLSCRASGFTFSNHAMSWVRQAPGKGLEWVSEISFNGHATRY   60
         :***************** *** .**  ** :.*.* ******  * *: *: .*  * *

CD16F1   ADSVKGRFTISRDNAKRAVYLQMNSLKPEDTAVYYCNVNLYNTGN--YWGQGTQVTVSS   116
CD16E11  ADSLKGRFTISRDNAKNTLYLQMNTLKPEDTAVYYCRKGWNATPQIGERGRGTQVTVSS   119
         ***:************.::*****:***********. .   * :    *:********

CD16F1      (SEQ ID NO:96)
CD16E11     (SEQ ID NO:99)
```

*FIG. 26*

MONOSPECIFIC AND MULTI-SPECIFIC ANTIBODIES

CROSS-REFERENCE TO RELATED APPLICATIONS

The present application is a National Phase Application of PCT/US2020/053064 filed Sep. 28, 2020, which claims the benefit of U.S. Provisional patent applications 62/907,275 filed Sep. 27, 2019 and 62/989,327 filed Mar. 13, 2020, the entire contents of all of which are incorporated by reference herein in their entirety.

SUMMARY

Disclosed herein are monospecific heavy chain only antibodies (HCAb) having specificity for CD47, human serum albumin (HSA), PD-L1, CD33, CD16, and LAG3, and multivalent single chain antibodies, incorporating two or more HCAb variable domains having specificity for one or more of these antigens.

Some embodiments are single domain antibodies comprising, exclusively or primarily, a VHH domain of a camelid antibody. These embodiments are monospecific and mono valent.

Some embodiments are HCAb or comprise a VHH domain fused to one or more constant domains from a conventional antibody, for example the Fc region of a human IgG antibody. These embodiments are monospecific, but typically bivalent. Other valencies are possible depending, for example, on the choice of constant domains. The Fc regions of IgA and IgM can confer higher valency.

Some embodiments comprise two VHH domains with specificity for the same antigen joined in a single amino acid chain (a multivalent single chain antibody). These embodiments are also monospecific and bivalent. Additional VHH domains can be joined for higher valency.

Some embodiments comprise two (or more) VHH domains, wherein each VHH domain has specificity for a distinct antigen joined in a single amino acid chain (a multivalent, multi-specific single chain antibody). These embodiments are multivalent and multi-specific. In further embodiments comprising three or more VHH domains, two or more VHH domains may have specificity for a same antigen while one or more other VHH domains has specificity for a distinct antigen. Such constructs have a higher order valency than specificity, Each of the monospecific embodiments will specificity for CD47, HSA, PD-L1, CD33, CD16, or LAG3. Each of the multi-specific embodiments have specificity for one or more of CD47, HSA, PD-L1, CD33, CD16, and LAG3, but may also have specificity for one or more other antigens.

Some of embodiments have specificity for HSA and one or more other antigens. In an aspect of these embodiments the HSA-specific domain confers extended half-life in the body while the other domains provide a therapeutic effect. In another aspect of these embodiments the HSA-specific domain may partially or completely inhibit the binding activity of an adjacent domain. The HSA-specific domain can be joined by a cleavable linker that is cleaved by a protease present at the intended sight of action, for example in a tumor, so that cleavage relieves the inhibition of the adjacent domain. Some multi-specific embodiments are trispecific.

In some embodiments comprising multiple antigen binding domains an antigen binding domain derived from a conventional VL-VH pairing can be used in place of one or more (but not all) of the VHH domains in the above embodiments.

The herein disclosed antigen binding domains with specificity for a particular antigen may be referred to as means for binding the antigen.

BRIEF DESCRIPTION OF THE DRAWINGS

FIG. 21 depicts amino acid sequence alignment of anti-CD47 VHH sequences.

FIG. 22 depicts amino acid sequence alignment of anti-PD-L1 VHH sequences.

FIG. 23 depicts amino acid sequence alignment of anti-HSA VHH sequences.

FIG. 24 depicts amino acid sequence alignment of anti-CD33 VHH sequences.

FIG. 25 depicts amino acid sequence alignment of anti-LAG3 VHH sequences.

FIG. 26 depicts amino acid sequence alignment of anti-CD16A VHH sequences.

DETAILED DESCRIPTION

Figure 1:
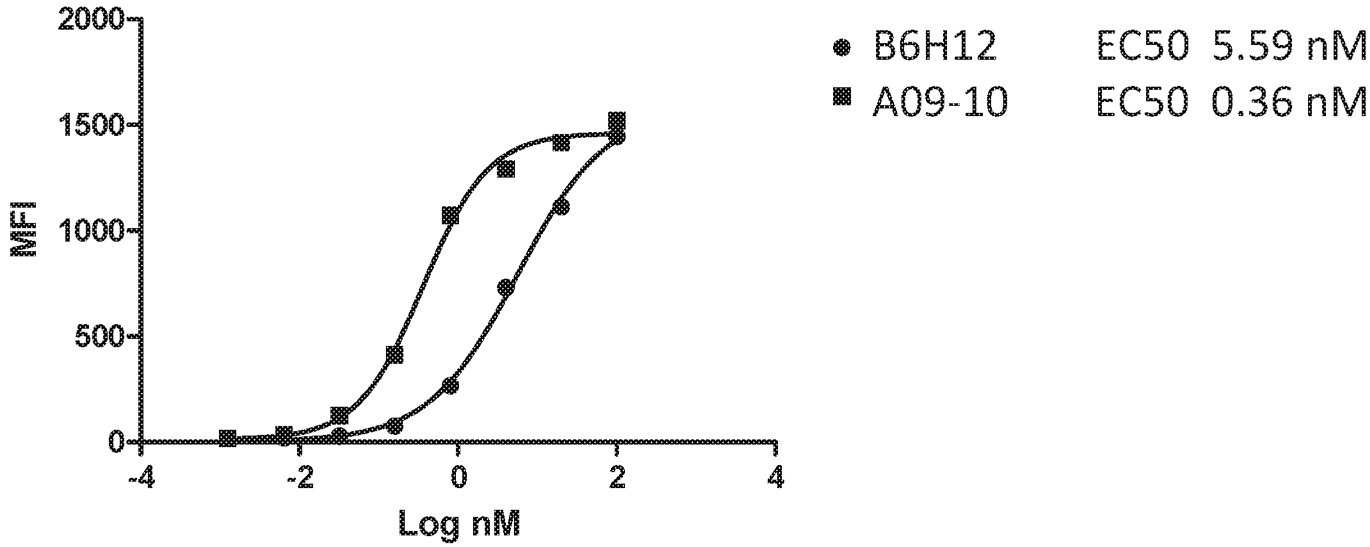
FIG. 1 depicts flow cytometric analysis of binding affinity of anti-CD47 HCAb A09-10 and B6H12 to CD47-overexpressing cell line.

Disclosed herein are monospecific heavy chain only antibodies (HCAb), or variable domains thereof (referred to as VHH single domain antibodies [sdAb]), having specificity for CD47, human serum albumin (HSA), PD-L1, CD33, CD16, and LAG3, and multivalent single chain antibodies (MVSCA), incorporating the variable domains of two or more HCAb, having specificity for one or more of these antigens.

In some embodiments the MVSCA comprise two or more HCAb variable domains with specificity for the same antigen. That is, the MVSCA are multivalent, but monospecific with respect to antigen. In some of these embodiments the MVSCA comprises two or more iterations of a same HCAb variable domain or multiple HCAb variable domains each with specificity for the same epitope. That is, they are multivalent, but monospecific with respect to epitope. Such MVSCA will bind to only a single site on an antigen monomer, but can cross-link multiple copies of the monomer. In other of these embodiments the MVSCA comprises two or more HCAb variable domains each with specificity for different epitopes of the same antigen. That is, they are multivalent, but multi-specific with respect to epitope. Such MVSCA may bind to multiple sites on an antigen monomer or cross-link multiple copies of the monomer.

In some embodiments the MVSCA comprise two or more HCAb variable domains with specificity for distinct antigens, that is, they are multivalent and multi-specific with respect to antigen. In further embodiments, the MVSCA comprise multiple HCAb variable domains wherein an additional variable domain is identical to a first HCAb variable domain, wherein an additional HCAb variable domain is different that a first HCAb variable domain but is specific for a different epitope on a same antigen, or wherein an additional HCAb variable domain is different that a first HCAb variable domain but is specific for a different antigen, in any combination.

The MVSCA comprising two or more HCAb variable domains may further comprise an HCAb constant domain. For example, the C-terminal HCAb variable domain can retain attachment to its original HCAb constant domain. Alternatively, the C-terminal HCAb variable domain can be attached to a constant domain or Fc region of a more conventional antibody, for example a human antibody, such as a human IgG antibody. In some embodiments a constant domain or complete Fc region may confer a particular functionality, as will be familiar to one of skill in the art. In other embodiments the MVSCA comprising two or more HCAb variable domains may further comprise an HCAb constant domain, wherein a HCAb constant domain is positioned between or N-terminally to the HCAb variable domains instead of, or in addition to, being positioned C-terminally to the HCAb variable domains.

Antigens

CD47 (Cluster of Differentiation 47), also known as integrin associated protein (IAP), is a 50 KDa transmembrane protein that in humans is encoded by the CD47 gene. CD47 belongs to the immunoglobulin superfamily and partners with membrane integrins and also binds the ligands thrombospondin-1 (TSP-1) and signal-regulatory protein alpha (SIRPα). Thrombospondin-1 is a secreted glycoprotein that plays a role in vascular development and angiogenesis, and in this later capacity the TSP1-CD47 interaction inhibits nitric oxide signaling at multiple levels in vascular cells. Binding of TSP-1 to CD47 influences several fundamental cellular functions including cell migration and adhesion, cell proliferation or apoptosis, and plays a role in the regulation of angiogenesis and inflammation. Signal-regulatory protein alpha is a transmembrane receptor present on myeloid cells. The CD47/SIRPα interaction leads to bidirectional signaling, resulting in different cell-to-cell responses including inhibition of phagocytosis, stimulation of cell-cell fusion, and T-cell activation. CD47 acts as a "don't eat me" signal to macrophages of the immune system which has made it a potential therapeutic target in some cancers.

Programmed cell death 1 (PD-1), also called CD279, is a type I membrane protein encoded in humans by the PDCD1 gene. It has two ligands, PD-L1 and PD-L2. PD-L1, also called CD274 or B7 homolog 1 (B7-H1) is a 40 kDa type I transmembrane protein encoded in humans by the CD274 gene. PD-1 is expressed on the surface of activated T cells, and PD-L1 is expressed on the surface of antigen presenting cells (APCs), such as dendritic cells and macrophages. PD-L1 is also overexpressed in several tumors, including breast, lung, bladder, head and neck, and other cancers. When PD-L1 or PD-L2 bind to PD-1, an inhibitory signal is transmitted into the T cell, which reduces cytokine production and suppresses T-cell proliferation.

The PD-1 pathway is a key immune-inhibitory mediator of T-cell exhaustion. PD-1 functions to limit the activity of already activated T cells in the periphery during the inflammatory response to infection in order to limit autoimmunity. Blockade of this pathway can lead to T-cell activation, expansion, and enhanced effector functions. As such, PD-1 negatively regulates T cell responses. PD-1 has been identified as a marker of exhausted T cells in chronic disease states, and blockade of PD-1: PD-L1 interactions has been shown to partially restore T cell function. (Sakuishi et al., JEM, 207:2187-2194, 2010). Methods and compositions for the treatment of persistent infections and cancer by inhibiting the PD-1 pathway are disclosed in WO 2006/133396. Human monoclonal antibodies to PD-L1 are described in WO 2007/005874, US2011/209230, U.S. Pat. No. 8,217,149 and WO2014/055897.

Human serum albumin (HSA) is the most abundant protein in human blood plasma; it constitutes about half of serum protein. Albumin transports hormones, fatty acids, and other compounds, buffers pH, and maintains oncotic pressure, among other functions. Albumin is synthesized in the liver as preproalbumin, which has an N-terminal peptide that is removed before the nascent protein is released from the rough endoplasmic reticulum. The product, proalbumin, is in turn cleaved in the Golgi vesicles to produce the secreted albumin. It has a serum half-life of approximately 20 days. The long serum half-life of albumin is achieved in part by its size which prevents clearance through the kidney, and by its interaction with the neonatal Fc receptor (FcRn). Fusion to an anti-albumin sdAb (single domain antibody) has been used to increase the half-life of an antitumor single chain antibody from 1-2 hr to approximate 10 days.

CD33 or Siglec-3 (sialic acid binding Ig-like lectin 3, SIGLEC3, SIGLEC-3, gp67, p67) is a transmembrane receptor expressed on cells of myeloid lineage. It is usually considered myeloid-specific, but it can also be found on some lymphoid cells. It binds sialic acids, therefore is a member of the SIGLEC family of lectins. The extracellular portion of this receptor contains two immunoglobulin domains (one IgV and one IgC2 domain), placing CD33 within the immunoglobulin superfamily. The intracellular portion of CD33 contains immunoreceptor tyrosine-based inhibitory motifs (ITIMs) that are implicated in inhibition of cellular activity. Diseases that can be treated by targeting CD33 include, but are not limited to, Alzheimer's disease and retinal diseases, such as macular edema (e.g., diabetic macular edema) and age-related macular degeneration (AMD) (e.g., dry AMD and wet AMD).

CD33 is the target of gemtuzumab ozogamicin (MYLOTARG®; Pfizer/Wyeth-Ayerst Laboratories), an antibody-drug conjugate (ADC) for the treatment of patients with acute myeloid leukemia. CD33 is also the target in vadastuximab talirine (SGN-CD33A), a novel antibody-drug conjugate being developed by Seattle Genetics, utilizing this company's ADC technology.

Lymphocyte-activation gene 3 (LAG-3), a 503 amino acid transmembrane protein, is an immune checkpoint receptor protein found on the cell surface of effector T cells and regulatory T cells (Tregs) and functions to control T cell response, activation and growth. LAG3 is a member of the immunoglobulin (lg) superfamily. LAG3 binding to MHC class II molecules results in delivery of a negative signal to LAG3-expressing cells and down-regulates antigen-dependent CD4 and CD8 T cell responses. LAG3 negatively regulates the ability of T cells to proliferate, produce cytokines and lyse target cells, termed as 'exhaustion' of T cells. Since LAG3 plays an important role in tumor immunity and infectious immunity, it is an ideal target for immunotherapy. Blocking LAG3 with antagonists, including monoclonal antibodies, has been studied in treatments of cancer and chronic viral infections.

CD16, also known as FcγRIII, is a cluster of differentiation molecule found on the surface of natural killer cells, neutrophils, monocytes, and macrophages. CD16 identified as an Fc receptor, exists in two forms encoded by separate genes: FcγRIIIa (CD16a), a transmembrane protein; and FcγRIIIb (CD16b), a GPI-anchored protein; and participates in signal transduction. The most well-researched membrane receptor implicated in triggering lysis by NK cells, CD16 is a molecule of the immunoglobulin superfamily (IgSF) involved in antibody-dependent cellular cytotoxicity (ADCC). It can be used to isolate populations of specific immune cells through fluorescent-activated cell sorting (FACS) or magnetic-activated cell sorting, using antibodies directed towards CD16. These receptors bind to the Fc portion of IgG antibodies, which then activates antibody-dependent cell-mediated cytotoxicity (ADCC) in human NK cells. CD16 is required for ADCC processes carried out by human monocytes. In humans, monocytes expressing CD16 have a variety of ADCC capabilities in the presence of specific antibodies, and can kill primary leukemic cells, cancer cell lines, and cells infected with hepatitis B virus. In addition, CD16 is able to mediate the direct killing of some virally infected and cancer cells without antibodies. After binding to ligands such as the conserved section of IgG antibodies, CD16 on human NK cells induce gene transcription of surface activation molecules such as IL-2-R (CD25) and inflammatory cytokines such as IFN-gamma and TNF. This CD16-induced expression of cytokine mRNA in NK cells is mediated by the nuclear factor of activated T cells (NFATp), a cyclosporin A (CsA)-sensitive factor that regulates the transcription of various cytokines. The upregulated expression of specific cytokine genes occurs via a CsA-sensitive and calcium-dependent mechanism.

CD16 plays a significant role in early activation of natural killer (NK) cells following vaccination. In addition, CD16 downregulation represents a possible way to moderate NK cell responses and maintain immune homeostasis in both T cell and antibody-dependent signaling pathways. In a normal, healthy individual, cross-linking of CD16 (FcγRIII) by immune complexes induces antibody-dependent cellular cytotoxicity (ADCC) in NK cells. However, this pathway can also be targeted in cancerous or diseased cells by immunotherapy. After influenza vaccination, CD16 downregulation was associated with significant upregulation of influenza-specific plasma antibodies, and positively correlated with degranulation of NK cells.

CD16 is often used as an additional marker to reliably identify different subsets of human immune cells. Several other CD molecules, such as CD11b and CD33, are traditionally used as markers for human myeloid-derived suppressor cells (MDSCs). However, since these markers are also expressed on NK cells and all other cells derived from myelocytes, other markers are required, such as CD14 and CD15. Neutrophils are found to be CD14 low and CD15 high, whereas monocytes are CD14 high and CD15 low. While these two markers are sufficient to differentiate between neutrophils and monocytes, eosinophils have a similar CD15 expression to neutrophils. Therefore, CD16 is used as a further marker to identify neutrophils: mature neutrophils are CD16 high, while eosinophils and monocytes are both CD16 low. CD16 allows for distinction between these two types of granulocytes. Additionally, CD16 expression varies between the different stages of neutrophil development: neutrophil progenitors that have differentiation capacity are CD16 low, with increasing expression of CD16 in metamyelocytes, banded, and mature neutrophils, respectively.

With its expression on neutrophils, CD16 represents a possible target in cancer immunotherapy. Margetuximab, an Fc-optimized monoclonal antibody that recognizes the human epidermal growth factor receptor 2 (HER2) expressed on tumor cells in breast, bladder, and other solid tumor cancers, targets CD16A in preference to CD16B. In addition, CD16 could play a role in antibody-targeting cancer therapies. Bispecific antibody fragments, such as anti-CD19/CD16, allow the targeting of immunotherapeutic drugs to the cancer cell. Anti-CD19/CD16 diabodies have been shown to enhance the natural killer cell response to B-cell lymphomas. Furthermore, targeting extrinsic factors such as FasL or TRAIL to the tumor cell surface triggers death receptors, inducing apoptosis by both autocrine and paracrine processes.

Antibodies

Antibodies, and their use for treatment of diseases, are well known in the art. As used herein, the term "antibody" refers to a monomeric or multimeric protein comprising one or more polypeptide chains that comprise antigen-binding sites. An antibody binds specifically to an antigen and may be able to modulate the biological activity of the antigen. As used herein, the term "antibody" can include "full length antibody" and "antibody fragments." The terms "binding site" or "antigen-binding site" as used herein denotes the region(s) of an antibody molecule to which a ligand actually binds. The term "antigen-binding site" comprises an antibody heavy chain variable domain (VH) and an antibody light chain variable domain (VL), or in the case of heavy chain only antibodies, an antibody heavy chain variable region.

Antibody specificity refers to selective recognition of the antibody for a particular epitope of an antigen. Natural antibodies, for example, are monospecific. The term "monospecific" antibody as used herein denotes an antibody that has one or more binding sites each of which bind to the same epitope of the same antigen. The monospecific antibodies disclosed herein are specific for CD47, HSA, PD-L1, CD33, CD16, or LAG3. In some embodiments, monospecific antibodies are heavy chain-only antibodies (HCAbs). In other embodiments, the monospecific antibody comprises a VHH domain fused to one or more protein domains including, for example, a human Fc region. In still other embodiments, the monospecific antibodies comprise a VHH as the only complete protein domain, that is, a single domain antibody. In some embodiments, the single domain antibody may additionally comprise a short peptide, such as a His-tag. The terms "VHH domain" and "HCAb variable domain" are used interchangeably. A VHH domain may be referred to as means for binding a particular target (such as, CD47, HSA, PD-L1, CD33, CD16, or LAG3). Any of the various antibody structures, formats, or constructs disclosed herein that contains a VHH domain or is constructed to contain a VHH domain can thus be referred to an antibody comprising means for binding the indicated target. Some embodiments may specifically include one or more particular antibody structures, formats, or constructs. Other embodiments may specifically exclude one or more particular antibody structures, formats, or constructs.

As used herein "an antibody having specificity for", "an antibody recognizing", "an antibody having affinity for", "an antibody with a binding site for", and similar constructions may be used interchangeably.

"Multi-specific antibodies" refers to antibodies that have two or more antigen-binding specificities. Multi-specific antibodies disclosed herein are specific for at least two of CD47, HSA, PD-L1, CD33, CD16, and LAG3, or for at least one of the foregoing specificities and at least a second specificity. In some embodiments, multi-specific antibodies disclosure herein can include two, three, four, or more domains capable of binding an antigen. Furthermore, multi-specific antibodies can include at least two copies of the same antigen-binding sequence, or two antigen-binding sequences which are specific for different epitopes on the same antigen (biparatopic) as long as the multi-specific antibody has specificity for at least one of CD47, HSA, PD-L1, CD33, CD16, and LAG3 and at least one second antigen. In some embodiments the multi-specific antibody (a MVSCA) has specificity for at least two of CD47, HSA, PD-L1, CD33, CD16, and LAG3. In some embodiments, the multi-specific antibodies disclosed herein are single chain antibodies. Accordingly, some multi-specific antibodies can be referred to as antibodies comprising means for binding a first target and means for binding a second target, etc.

"Bispecific antibodies" refers to antibodies which have two different antigen-binding specificities. In some embodiments, bispecific antibodies disclosed herein are specific for two of CD47, HSA, PD-L1, CD33, CD16, and LAG3. Amino acid sequences encoding antigen-binding portions of the bispecific antibodies can be linked in various configurations. In some embodiments, the amino acid sequences encoding the antibody-binding portions of the bispecific antibodies are connected by a linker as disclosed herein.

"Tri-specific antibodies" refers to antibodies which have three different antigen-binding specificities. In some embodiments, the tri-specific antibodies disclosed herein are specific for three of CD47, HSA, PD-L1, CD33, CD16, and LAG3. Amino acid sequences encoding antigen-binding portions of the tri-specific antibodies can be linked in various configurations. In some embodiments, the amino acid sequences encoding the antibody-binding portions of the tri-specific antibodies are connected by a linker as disclosed herein. In some embodiments two linkers are used, which can be the same of different.

"Quadbodies" refers to antibodies which have four different antigen-binding specificities. In some embodiments, the quadbodies disclosed herein are specific for four of CD47, HSA, PD-L1, CD33, CD16, and LAG3. Amino acid sequences encoding antigen-binding portions of the quadbodies can be linked in various configurations. In some embodiments, the amino acid sequences encoding the antibody-binding portions of the quadbodies are connected by a linker as disclosed herein. In some embodiments two linkers are used, which can be the same of different.

The term "valent" as used herein denotes the presence of a specified number of binding sites in an antibody molecule. As such, the terms "bivalent", "trivalent", "tetravalent", "pentavalent", "hexavalent", "heptavalent", and "octavalent" denote the presence of two binding sites, three binding sites, four binding sites, five binding sites, six binding sites, seven binding sites, and eight binding sites, respectively, in an antibody molecule. The bispecific antibodies disclosed herein are "bivalent". The tri-specific antibodies disclosed herein are "trivalent." The quadbodies disclosed herein are "tetravalent." However, monospecific multivalent antibodies, for example, bivalent, trivalent, and tetravalent antibodies, are within the scope of the present disclosure in which the multiple antigen-binding sites bind the same antigen. The antigen-binding sites of monospecific bivalent and trivalent (or higher valency) antibodies can bind either the same epitope or different epitopes on the antigen. Similarly, by combining multiple monospecific binding sites with binding sites for one or more other specificities antibodies can be constructed in which the valency is of a higher order than the multi-specificity, for example, a trivalent, bispecific antibody.

By "full length antibody" herein is meant the structure that constitutes the natural biological form of an antibody, including variable and constant regions. For example, in most mammals, including humans and mice, the full length antibody of the IgG class is a tetramer and consists of two identical pairs of two immunoglobulin chains, each pair having one light and one heavy chain, each light chain comprising immunoglobulin domains VL and CL, and each heavy chain comprising immunoglobulin domains VH, CH1, CH2, and CH3. In some mammals, for example in camels and llamas, IgG antibodies can also consist of only two heavy chains (HCAb), each heavy chain comprising a variable domain attached to the Fc region (CH2 and CH3 domains).

Tetrameric antibodies are typically composed of two identical pairs of polypeptide chains, each pair having one "light" (typically having a molecular weight of about 25 kDa) and one "heavy" chain (typically having a molecular weight of about 50-70 kDa). Each of the light and heavy chains are made up of two distinct regions, referred to as the variable and constant regions. For the IgG class of immunoglobulins, the heavy chain is composed of four immunoglobulin domains linked from N- to C-terminus in the order VH-CH1-CH2-CH3, referring to the heavy chain variable domain, heavy chain constant domain 1, heavy chain constant domain 2, and heavy chain constant domain 3 respectively (also referred to as VH-Cγ1-Cγ2-Cγ3, referring to the heavy chain variable domain, constant gamma 1 domain, constant gamma 2 domain, and constant gamma 3 domain respectively). The IgG light chain is composed of two immunoglobulin domains linked from N- to C-terminus in the order VL-CL, referring to the light chain variable domain and the light chain constant domain respectively. The constant regions show less sequence diversity, and are responsible for binding a number of natural proteins to elicit important biochemical events.

The variable region of an antibody contains the antigen binding determinants of the molecule, and thus determines the specificity of an antibody for its target antigen. The variable region is so named because it is the most distinct in sequence from other antibodies within the same class. In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. There are six CDRs total, three each per heavy and light chain, designated VH CDR1, VH CDR2, VH CDR3, VL CDR1, VL CDR2, and VL CDR3. The variable region outside of the CDRs is referred to as the framework (FR) region. Although not as diverse as the CDRs, sequence variability does occur in the FR region between different antibodies. Overall, this characteristic architecture of antibodies provides a stable scaffold (the FR region) upon which substantial antigen binding diversity (the CDRs) can be explored by the immune system to obtain specificity for a broad array of antigens.

The genes encoding the immunoglobulin locus comprise multiple V region sequences along with shorter nucleotide sequences named "D" and "J" and it is the combination of the V, D, and J nucleotide sequence that give rise to the VH diversity.

Antibodies are grouped into classes, also referred to as isotypes, as determined genetically by the constant region. Human constant light chains are classified as kappa (CK) and lambda (Cλ) light chains. Heavy chains are classified as mu (μ), delta (δ), gamma (γ), alpha (α), or epsilon (ε), and define the antibody's isotype as IgM, IgD, IgG, IgA, and IgE, respectively. The IgG class is the most commonly used for therapeutic purposes. In humans this class comprises subclasses IgG1, IgG2, IgG3, and IgG4. In mice this class comprises subclasses IgG1, IgG2a, IgG2b, IgG3. IgM has subclasses, including, but not limited to, IgM1 and IgM2. IgA has several subclasses, including but not limited to IgA1 and IgA2. Thus, "isotype" as used herein is meant any of the classes or subclasses of immunoglobulins defined by the chemical and antigenic characteristics of their constant regions. The known human immunoglobulin isotypes are IgG1, IgG2, IgG3, IgG4, IgA1, IgA2, IgM1, IgM2, IgD, and IgE. The disclosed HCAb antibodies, bispecific, and multi-specific antibodies can have constant regions comprising all, or part, of the above-described isotypes.

Also within the scope of the present disclosure are antibody fragments including, but are not limited to, (i) a Fab fragment comprising VL, CL, VH, and CH1 domains, (ii) a Fd fragment comprising VH and CH1 domains, (iii) a Fv fragment comprising VL and VH domains of a single antibody; (iv) a dAb fragment comprising a single variable region, (v) isolated CDR regions, (vi) $F(ab')_2$ fragment, a bivalent fragment comprising two linked Fab fragments, and (vii) a single chain Fv molecule (scFv), wherein a VH domain and a VL domain are linked by a peptide linker which allows the two domains to associate to form an antigen binding site. Trivalent or tetravalent antibody fragments comprising variable domains of having three different specificities and linked by cleavable or uncleavable linkers are also disclosed. In certain embodiments, antibodies are produced by recombinant DNA techniques. In additional embodiments, antibodies are produced by enzymatic or chemical cleavage of naturally occurring antibodies.

"Single-chain antibody" as used herein, refers to a fusion protein of the antigen-binding portions of antibodies (i.e., variable regions) generally connected by a linker peptide. Disclosed herein are multivalent mono- and multi-specific single chain antibodies. The monospecific multivalent antibodies have specificity for at least one of CD47, HSA, PD-L1, CD33, CD16, and LAG3. The multi-specific single chain antibodies have specificity for at least one of CD47, HSA, PD-L1, CD33, CD16, and LAG3 plus at least one further specificity. In some embodiments, the multi-specific single chain antibodies have specificity for at least two of CD47, HSA, PD-L1, CD33, CD16, and LAG3.

By "humanized" antibody as used herein is meant an antibody comprising a human framework region (FR) and one or more complementarity determining regions (CDR's) from a non-human antibody. The non-human antibody providing the CDR's is called the "donor" and the human immunoglobulin providing the framework is called the "acceptor". In certain embodiments, humanization relies principally on the grafting of donor CDRs onto acceptor (human) VL or VH frameworks. This strategy is referred to as "CDR grafting". "Backmutation" of selected acceptor framework residues to the corresponding donor residues is often required to regain affinity that is lost in the initial grafted construct. The humanized antibody optimally also will comprise at least a portion of an immunoglobulin constant region, typically that of a human immunoglobulin, and often will typically comprise a human Fc region. Humanization or other methods of reducing the immunogenicity of nonhuman antibody variable regions may include resurfacing methods. In one embodiment, selection based methods may be employed to humanize and/or affinity mature antibody variable regions, that is, to increase the affinity of the variable region for its target antigen. Other humanization methods may involve the grafting of only parts of the CDRs, including but not limited to methods described in U.S. Pat. No. 6,797,492, incorporated by reference herein for all it discloses regarding CDR grafting. Structure-based methods may be employed for humanization and affinity maturation, for example as described in U.S. Pat. No. 7,117,096, incorporated by reference herein for all it discloses regarding humanization and affinity maturation.

In various embodiments herein, the antibodies are heavy chain only antibodies (HCAb). Camelids (camels, dromedary, and llamas) contain, in addition to conventional heavy and light chain antibodies (2 light chains and 2 heavy chains in one antibody), two-chain antibodies (containing only variant heavy chains). The dimeric antibodies are coded for by a distinct set of VH segments referred to as VHH genes. The VH and VHH are interspersed in the genome (i.e., they appear mixed in between each other). The identification of an identical D segment in a VH and VHH cDNA suggests the common use of the D segment for VH and VHH. Natural VHH-containing antibodies are missing the entire CH1 domain of the constant region of the heavy chain. The exon coding for the CH1 domain is present in the genome but is spliced out due to the loss of a functional splice acceptor sequence at the 5' side of the CH1 exon. As a result the VDJ region is spliced onto the CH2 exon. When a VHH is recombined onto such constant regions (CH2, CH3), an antibody is produced in which the half-antibody is a single chain instead of a light chain/heavy chain pair (i.e., an antibody of two heavy chains without a light chain interaction). Binding of an antigen is different from that seen with a conventional antibody, but high affinity is achieved the same way, i.e., through hypermutation of the variable region and selection of the cells expressing such high affinity antibodies.

In an exemplary embodiment, the disclosed HCAb are produced by immunizing a transgenic mouse in which endogenous murine antibody expression has been eliminated and camelid transgenes have been introduced. HCAb mice are disclosed in U.S. Pat. Nos. 8,883,150, 8,921,524, 8,921,522, 8,507,748, 8,502,014, US 2014/0356908, US2014/0033335, US2014/0037616, US2014/0356908, US2013/0344057, US2013/0323235, US2011/0118444, and US2009/0307787, all of which are incorporated herein by reference for all they disclose regarding heavy chain only antibodies and their production in transgenic mice. The HCAb mice are immunized and the resulting primed spleen cells fused with a murine myeloma cells to form hybridomas.

In other embodiments, HCAb are produced by immunizing llamas with a desired antigen, and isolating sequencing encoding the VHH regions of resulting antigen binding antibodies. In one embodiment, the VHH are isolated using a phage display library. See, for example, WO 91/17271; WO 92/01047; and WO 92/06204 (each of which is incorporated by reference in its entirety for description of making phage libraries).

Also disclosed herein are multi-specific or multivalent antibodies in which two or more antigen binding domains are joined in a single fusion protein. Multi-specific antibodies can take many forms including (i) multi-specific Fv fragments; (ii) a heavy chain of a first specificity having associated therewith (or fused thereto) a second VH domain having a second specificity; (iii) tetrameric monoclonal antibodies with a first specificity having associated therewith with a second VH domain having a second specificity, wherein the second VH domain is associated with a first VH domain); (iv) Fab fragments (VH-CH1/VL-CL) of a first specificity having associated therewith a second VH domain with a second specificity. Exemplary Fab fragments include those in which the second VH sequence having the second specificity is associated with the C-terminus or the N-terminus of the first VH domain, or the C-terminus or the N-terminus of the first CH1 or first CL domains. In additional embodiments, VH sequences having a second and/or a third specificity (or more) can be associated with (or fused to) the C-terminus or the N-terminus of the first VH domain, or the C-terminus or the N-terminus of the first CH1 or first CL domains. In various embodiments any of these formats can include at least one of the herein disclosed HCAb variable domains.

Multi-specific or multivalent antibodies may include linker sequences linking a particular antigen-binding domain (such as a VH or VHH) to another antigen-binding domain and which allows for proper folding of the amino acid sequences to generate the desired three-dimensional conformation and antigen binding profiles. Generally a linker sequence will be a short amino acid sequence that provides sufficient space and flexibility between the domains for them to fold properly. The linker may also cause steric hindrance so as to facilitate binding to the target of each domain. Suitable linkers include, but are not limited to, the linkers of Table 15 (SEQ ID Nos: 100-119), EPKSCD (SEQ ID NO:224), and ASTKGP (SEQ ID NO:225). Further linkers will be known to the person of skill in the art.

Also within the scope of the present disclosure are amino acid sequence variants of the monospecific or multi-specific antibodies disclosed herein. Amino acid sequence variants are prepared by introducing appropriate nucleotide changes into the antibody-encoding DNA, or by peptide synthesis. Such variants include, for example, deletions from, and/or insertions into and/or substitutions of, residues within the amino acid sequences of the antibodies of the examples herein. Any combination of deletion, insertion, and substitution is made to arrive at the final construct, provided that the final construct possesses the desired characteristics. The amino acid changes also may alter post-translational processes of the humanized or variant antibodies, such as changing the number or position of glycosylation sites.

A useful method for identification of certain residues or regions of the antibodies that are preferred locations for mutagenesis is called "alanine scanning mutagenesis". A residue or group of target residues are identified (e.g., charged residues such as Arg, Asp, His, Lys, and Glu) and replaced by a neutral amino acid (most preferably alanine or polyalanine) to affect the interaction of the amino acids with antigen. Those amino acid locations demonstrating functional sensitivity to the substitutions then are refined by introducing further or other variants at, or for, the sites of substitution. Thus, while the site for introducing an amino acid sequence variation is predetermined, the nature of the mutation per se need not be predetermined. For example, to analyze the performance of a mutation at a given site, alanine scanning or random mutagenesis is conducted at the target codon or region and the expressed antibody variants are screened for the desired activity.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody disclosed herein with an N-terminal methionyl residue or the antibody fused to an epitope tag. Other insertional variants of the antibody molecules include the fusion to the N- or C-terminus of the antibody of an enzyme or a polypeptide which increases the serum half-life of the antibody.

Another type of variant is an amino acid substitution variant. These variants have at least one amino acid residue in the antibody molecule removed and a different residue inserted in its place. The sites of greatest interest for substitutional mutagenesis include the hypervariable regions, but FR alterations are also contemplated. Conservative substitutions are shown in Table 1 under the heading of "preferred substitutions". If such substitutions result in a change in biological activity, then more substantial changes, denominated "exemplary substitutions" in Table 1, or as further described below in reference to amino acid classes, may be introduced and the products screened.

TABLE 1

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp; Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Leu; Val; Ile; Ala; Tyr | Tyr |
| Pro (P) | Ala | Ala |
| Ser (S) | Thr | Thr |
| Thr (T) | Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) Hydrophobic: Norleucine, Met, Ala, Val, Leu, Ile;
(2) Neutral hydrophilic: Cys, Ser, Thr;
(3) Acidic: Asp, Glu;
(4) Basic: Asn, Gin, His, Lys, Arg;
(5) Residues that influence chain orientation: Gly, Pro; and
(6) Aromatic: Trp, Tyr, Phe.

Non-conservative substitutions will entail exchanging a member of one of these classes for another class.

Any cysteine residue not involved in maintaining the proper conformation of the monospecific or multi-specific antibodies also may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

Another type of substitutional variant involves substituting one or more hypervariable region residues of a parent antibody (e.g., a humanized or camelid antibody). Generally, the resulting variant(s) selected for further development will have improved biological properties relative to the parent antibody from which they are generated. A convenient way for generating such substitutional variants is affinity maturation using phage display. Briefly, several hypervariable region sites (e.g., 6-7 sites) are mutated to generate all possible amino substitutions at each site. The antibody variants thus generated are displayed in a monovalent fashion from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine scanning mutagenesis can be performed to identified hypervariable region residues contributing significantly to antigen binding. Alternatively, or in addition, it may be beneficial to analyze a crystal structure of the antigen-antibody complex to identify contact points between the antibody and antigen. Such contact residues and neighboring residues are candidates for substitution according to the techniques elaborated herein. Once such variants are generated, the panel of variants is subjected to screening as described herein and antibodies with superior properties in one or more relevant assays may be selected for further development.

Another type of amino acid variant of the antibody alters the original glycosylation pattern of the antibody. By altering is meant deleting one or more carbohydrate moieties found in the antibody, and/or adding one or more glycosylation sites that are not present in the antibody.

Glycosylation of antibodies is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-acetylgalactosamine, galactose, or xylose to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original antibody (for O-linked glycosylation sites).

Nucleic acid molecules encoding amino acid sequence variants of the monospecific or multi-specific antibodies are prepared by a variety of methods known in the art. These methods include, but are not limited to, isolation from a natural source (in the case of naturally occurring amino acid sequence variants) or preparation by oligonucleotide-mediated (or site-directed) mutagenesis, PCR mutagenesis, and cassette mutagenesis of an earlier prepared variant or a non-variant version of an antibody disclosed herein.

Other modifications of the monospecific or multi-specific antibodies are contemplated. For example, it may be desirable to modify the antibodies with respect to effector function, so as to enhance the effectiveness of the antibody in treating disease, for example. For example cysteine residue(s) may be introduced in the Fc region, thereby allowing interchain disulfide bond formation in this region. The homodimeric antibody thus generated may have improved internalization capability and/or increased complement-mediated cell killing and antibody-dependent cellular cytotoxicity (ADCC). Homodimeric antibodies with enhanced anti-tumor activity may also be prepared using heterobifunctional cross-linkers. Alternatively, an antibody can be engineered which has dual Fc regions and may thereby have enhanced complement lysis and ADCC capabilities.

In another embodiment, an antibody may be conjugated to a "receptor" (such streptavidin) for utilization in pretargeting wherein the antibody-receptor conjugate is administered to the patient, followed by removal of unbound conjugate from the circulation using a clearing agent and then administration of a "ligand" (e.g., avidin) which is conjugated to a cytotoxic agent (e.g., a radionuclide).

Covalent modifications of the monospecific or multi-specific antibodies are also included within the scope of this disclosure. They may be made by chemical synthesis or by enzymatic or chemical cleavage of the antibody, if applicable. Other types of covalent modifications of the antibodies are introduced into the molecule by reacting targeted amino acid residues of the antibody with an organic derivatizing agent that is capable of reacting with selected side chains or the N- or C-terminal residues. Exemplary covalent modifications of polypeptides are described in U.S. Pat. No. 5,534,615, specifically incorporated herein by reference for all it discloses regarding covalent modifications of polypeptides. An exemplary type of covalent modification of the antibody comprises linking the antibody to one of a variety of nonproteinaceous polymers, e.g., polyethylene glycol, polypropylene glycol, or polyoxyalkylenes, in the manner set forth in U.S. Pat. Nos. 4,640,835, 4,496,689, 4,301,144, 4,670,417, 4,791,192, or U.S. Pat. No. 4,179,337.

The monospecific or multi-specific antibodies disclosed herein may be produced by recombinant means. Thus, disclosed herein are nucleic acids encoding the antibodies, expression vectors containing nucleic acids encoding the antibodies, and cells comprising the nucleic acid encoding the antibodies. Methods for recombinant production are widely known in the state of the art and comprise protein expression in prokaryotic and eukaryotic cells with subsequent isolation of the antibody and usually purification to a pharmaceutically acceptable purity. For the expression of the antibodies as aforementioned in a host cell, nucleic acids encoding the antibody sequences are inserted into expression vectors by standard methods. Expression is performed in appropriate prokaryotic or eukaryotic host cells like CHO cells, NSO cells, SP2/0 cells, HEK293 cells, COS cells, PER.C6 cells, yeast, or *E. coli* cells, and the antibody is recovered from the cells (supernatant or cells after lysis). It is to be understood that any recombinantly-expressed protein requires an initiator methionine (or formyl-methionine) or signal sequence at its N-terminus, depending on the expression system used and whether the protein is expressed in the cytoplasm or secreted. Thus in some embodiments, the herein disclosed protein sequences are modified with such additional amino acids at their N-terminus. In some embodiments such N-terminal sequences are cleaved (in whole or in part) from the fully mature sequence, while in other embodiments they are retained.

Accordingly certain embodiments disclosed herein include a method for the preparation of a monospecific or multi-specific antibody, comprising the steps of a) transforming a host cell with at least one expression vector comprising nucleic acid molecules encoding the antibody; b) culturing the host cell under conditions that allow synthesis of the antibody molecule; and c) recovering said antibody molecule from the culture.

The antibodies are suitably separated from the culture medium by conventional immunoglobulin purification procedures such as, for example, protein A-Sepharose, hydroxylapatite chromatography, gel electrophoresis, dialysis, or affinity chromatography.

As used herein, the expressions "cell," "cell line," and "cell culture" are used interchangeably and all such designations include progeny. Thus, the words "transformants" and "transformed cells" include the primary subject cell and cultures derived therefrom without regard for the number of transfers. It is also understood that all progeny may not be precisely identical in DNA content, due to deliberate or inadvertent mutations. Variant progeny that have the same function or biological activity as screened for in the originally transformed cell are included. Where distinct designations are intended, it will be clear from the context.

The term "transformation" as used herein refers to process of transfer of a vectors/nucleic acid into a host cell. If cells without formidable cell wall barriers are used as host cells, transfection can be carried out e.g. by the calcium phosphate precipitation method. However, other methods for introducing DNA into cells such as by nuclear injection or by protoplast fusion may also be used. If prokaryotic cells or cells which contain substantial cell wall constructions are used, e.g. one method of transfection is calcium treatment using calcium chloride.

As used herein, "expression" refers to the process by which a nucleic acid is transcribed into mRNA and/or to the process by which the transcribed mRNA (also referred to as transcript) is subsequently being translated into peptides, polypeptides, or proteins. The transcripts and the encoded polypeptides are collectively referred to as gene product. If the polynucleotide is derived from genomic DNA, expression in a eukaryotic cell may include splicing of the mRNA.

A "vector" is a nucleic acid molecule, in particular self-replicating, which transfers an inserted nucleic acid molecule into and/or between host cells. The term includes vectors that function primarily for insertion of DNA or RNA into a cell (e.g., chromosomal integration), replication of vectors that function primarily for the replication of DNA or RNA, and expression vectors that function for transcription and/or translation of the DNA or RNA. Also included are vectors that provide more than one of the functions as described.

An "expression vector" is a polynucleotide which, when introduced into an appropriate host cell, can be transcribed and translated into a polypeptide. An "expression system" usually refers to a suitable host cell comprised of an expression vector that can function to yield a desired expression product.

The term "host cell" as used herein denotes any kind of cellular system which can be engineered to generate the antibodies disclosed herein. In one embodiment HEK293 cells and CHO cells are used as host cells.

The control sequences that are suitable for prokaryotes, for example, include a promoter, optionally an operator sequence, and a ribosome binding site. Eukaryotic cells are known to utilize promoters, enhancers and polyadenylation signals.

A nucleic acid is "operably linked" when it is placed in a functional relationship with another nucleic acid sequence. For example, DNA for a pre-sequence or secretory leader is operably linked to DNA for a polypeptide if it is expressed as a pre-protein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading frame. However, enhancers do not have to be contiguous. Linking is accomplished by ligation at convenient restriction sites. If such sites do not exist, the synthetic oligonucleotide adaptors or linkers are used in accordance with conventional practice.

Also disclosed herein are isolated nucleic acid encoding the monospecific or multi-specific antibodies, vectors and host cells comprising the nucleic acids, and recombinant techniques for the production of the antibodies.

For recombinant production of the antibodies, the nucleic acid encoding it may be isolated and inserted into a replicable vector for further cloning (amplification of the DNA) or for expression. In some embodiments, the antibody may be produced by homologous recombination, e.g. as described in U.S. Pat. No. 5,204,244, specifically incorporated herein by reference for all it discloses regarding antibody production. DNA encoding the antibody is readily isolated and sequenced using conventional procedures (e.g., by using oligonucleotide probes that are capable of binding specifically to genes encoding the heavy and light chains of the antibody). Many vectors are available. The vector components generally include, but are not limited to, one or more of the following: a signal sequence, an origin of replication, one or more marker genes, an enhancer element, a promoter, and a transcription termination sequence, e.g., as described in U.S. Pat. No. 5,534,615, specifically incorporated herein by reference for all it discloses regarding protein expression.

Suitable host cells for cloning or expressing the DNA in the vectors herein are the prokaryote, yeast, or higher eukaryote cells described above. Suitable prokaryotes for this purpose include eubacteria, such as Gram-negative or Gram-positive organisms, for example, *Enterobacteriaceae* such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as Bacilli such as *B. subtilis* and *B. licheniformis, Pseudomonas* such as *P. aeruginosa*, and *Streptomyces*. One exemplary *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting.

In addition to prokaryotes, eukaryotic microbes such as filamentous fungi or yeast are suitable cloning or expression hosts for monospecific or multi-specific antibody-encoding vectors. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe; Kluyveromyces* hosts such as, e.g., *K. lactis, K. fragilis* (ATCC 12,424), K. *bulgaricus* (ATCC 16,045), *K. wickeramii* (ATCC 24,178), *K. waltii* (ATCC 56,500), K. *drosophilarum* (ATCC 36,906), *K. thermotolerans*, and *K. marxianus; yarrowia* (EP 402,226); *Pichia pastoris* (EP 183,070); *Candida; Trichoderma* reesia (EP 244,234); *Neurospora crassa; Schwanniomyces* such as *Schwanniomyces occidentalis*; and filamentous fungi such as, e.g., *Neurospora, Penicillium, Tolypocladium*, and *Aspergillus* hosts such as *A. nidulans* and *A. niger.*

Suitable host cells for the expression of glycosylated monospecific or multi-specific antibodies are derived from multicellular organisms, including invertebrate cells such as plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruitfly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells. Plant cell cultures of cotton, corn, potato, soybean, *petunia*, tomato, and tobacco can also be utilized as hosts.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture); baby hamster kidney cells (BHK, ATCC CCL 10); Chinese hamster ovary cells/-DHFR (CHO); mouse sertoli cells (TM4); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells; MRC 5 cells; FS4 cells; and a human hepatoma line (Hep G2).

Host cells are transformed with the above-described expression vectors for monospecific or multi-specific antibody production and cultured in conventional nutrient media modified as appropriate for inducing promoters, selecting transformants, or amplifying the genes encoding the desired sequences.

The host cells used to produce the monospecific or multi-specific antibodies may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, U.S. Pat. Nos. 4,767,704; 4,657,866; 4,927,762; 4,560,655; or U.S. Pat. No. 5,122,469; WO 90/03430; WO 87/00195; or US Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

When using recombinant techniques, the antibody can be produced intracellularly, in the periplasmic space, or directly secreted into the medium. If the antibody is produced intracellularly, as a first step, the particulate debris, either host cells or lysed fragments, is removed, for example, by centrifugation or ultrafiltration.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human $\gamma 1$, $\gamma 2$, or $\gamma 4$ heavy chains, although Protein A can be used to purify antibody that do not have Fc regions. Protein G is useful for all mouse isotypes and for human $\gamma 3$. The matrix to which the affinity ligand is attached is most often agarose, but other matrices are available. Mechanically stable matrices such as controlled pore glass or poly(styrenedivinyl)

benzene allow for faster flow rates and shorter processing times than can be achieved with agarose. Where the antibody comprises a CH3 domain, the Bakerbond ABX™ resin is useful for purification. Antibodies and antibody fragments disclosed herein can also be synthesized with histidine tags and affinity purified by metal affinity chromatography.

Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

Also disclosed herein are multi-specific single chain antibodies that are cleavable in a tumor microenvironment. In some embodiments, a tumor targeting domain (such as a tumor antigen binding domain) or other functional domain (such as an anti-HSA domain, which can extend systemic half-life) is cleaved at the linker once the multi-specific single chain antibody reaches the tumor, in order to release the other domain(s) which bring about the therapeutic effect. The tumor microenvironment contains a multitude of proteases capable of cleaving the linkers disclosed herein. Non-limiting examples of tumor proteases include, but are not limited to, matrix metalloproteinases (e.g., MMP1, MMP2, MMP3, MMP7, MMP8, MMP9, MMP12, and MMP14), ADAM (a disintegrin and metalloproteinase; e.g., ADAM10 and ADAM17), a kallikrein-related peptidase (e.g., KLK1, KLK2, KLK3, and KLK6), a cathepsin (e.g., CTS-B, CTS-L, and CTS-S), a urokinase plasminogen activator (uPA), a hepsin (HPN), a matriptase, a legumain, or a dipeptidyl peptidase (e.g., DDP4).

Antibody Compositions

Also disclosed herein are pharmaceutical compositions comprising a monospecific or multi-specific antibody in which the specificities include CD47, HSA, PD-L1, CD33, CD16, or LAG3. Also disclosed is the use of the antibodies described herein for the manufacture of a pharmaceutical composition. Also disclosed are methods of using the disclosed antibodies and pharmaceutical compositions comprising the antibodies for the treatment of various diseases and disorders.

A pharmaceutical composition is one intended and suitable for the treatment of disease in humans. That is, it provides overall beneficial effect and does not contain amounts of ingredients or contaminants that cause toxic or other undesirable effects unrelated to the provision of the beneficial effect. A pharmaceutical composition will contain one or more active agents and may further contain solvents, buffers, diluents, carriers, and other excipients to aid the administration, solubility, absorption or bioavailability, and or stability, etc. of the active agent(s) or overall composition.

The monospecific or multi-specific antibodies disclosed herein may also be formulated in liposomes. Liposomes containing the antibody are prepared by methods known in the art, such as described in U.S. Pat. Nos. 4,485,045, 4,544,545, and 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibodies can be conjugated to the liposomes via a disulfide interchange reaction.

As used herein, "pharmaceutical carrier" includes any and all solvents, dispersion media, coatings, antibacterial and antifungal agents, isotonic and absorption delaying agents, and the like that are physiologically compatible. Preferably, the carrier is suitable for intravenous, intramuscular, intraocular, intravitreal, subcutaneous, parenteral, spinal or epidermal administration (e.g. by injection or infusion). In some embodiments, the carrier is aqueous.

A composition disclosed herein can be administered by a variety of methods known in the art. As will be appreciated by the skilled artisan, the route and/or mode of administration will vary depending upon the desired results. To administer the disclosed antibodies by certain routes of administration, it may be necessary to associate the antibodies with, or co-administer the antibodies with, a material to prevent its inactivation. For example, the antibodies may be administered to a subject in an appropriate carrier, for example, liposomes, or a diluent. Pharmaceutically acceptable diluents include saline and aqueous buffer solutions. Pharmaceutical carriers include sterile aqueous solutions or dispersions and sterile powders for the extemporaneous preparation of sterile injectable solutions or dispersion. The use of such media and agents for pharmaceutically active substances is known in the art.

The phrases "parenteral administration" and "administered parenterally" as used herein means modes of administration other than enteral and topical administration, usually by injection, and includes, without limitation, intravenous, intramuscular, intra-arterial, intrathecal, intracapsular, intraorbital, intracardiac, intraocular, intravitreal, intradermal, intraperitoneal, transtracheal, subcutaneous, subcuticular, intra-articular, subcapsular, subarachnoid, intraspinal, epidural, and intrasternal injection and infusion.

These compositions may also contain excipients such as preservatives, wetting agents, emulsifying agents, and dispersing agents. Prevention of presence of microorganisms may be ensured both by sterilization procedures, supra, and by the inclusion of various antibacterial and antifungal agents, for example, paraben, chlorobutanol, phenol, sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

In some embodiments, the pharmaceutical composition comprising the antibody is a lyophilization cake. The lyophilization cake may further comprise bulking agents, buffers and/or salts, or other excipients, such as described herein. The lyophilized composition can be reconstituted by addition of sterile water or aqueous buffer, for administration to the patient.

Regardless of the route of administration selected, the disclosed antibodies, which may be used in a suitable hydrated form, and/or the pharmaceutical compositions containing the antibodies, are formulated into pharmaceutically acceptable dosage forms by conventional methods known to those of skill in the art.

Actual dosage levels of the active ingredients in the pharmaceutical compositions may be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions of the present invention employed, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

Functions of the Disclosed MVSCA and their Component Antibody Domains and Linkers Anti-HSA VHH The primary function of an anti-HSA domain within a MVSCA is to bind HSA and thereby extend half-life of the MVSCA in the body. The inclusion of an anti-HSA domain can extend a half-life that might otherwise be only few hours to more than a week. Most often, a single anti-HSA domain is sufficient for this purpose. Thus, an anti-HSA domain constitutes means for extending MVSCA half-life.

By binding HSA, the anti-HSA domain can mediate partial or complete blocking of an adjacent binding domain, inhibiting or modulating its activity (effective affinity). Whether the block is substantially complete or only partial depends on the length of the linker between the two domains the shorter the linker the more complete the blocking of antigen binding. Partial blocking can often be observed as a reduction in the apparent or effective affinity of the VHH for its antigen. In some cases, partial blocking is observed as an increase in specificity of the VHH, as the domain continues to bind antigens for which is has higher affinity, but fails to exhibit significant binding to lower affinity antigens. Thus, an anti-HSA domain constitutes means for inhibiting the binding activity of an adjacent binding domain.

The block can also be reversible. By placing the anti-HSA domain in a terminal position in the MVSCA and attaching it with a cleavable linker, the anti-HSA domain can be removed and the full binding activity of the adjacent binding domain restored. Such antibody constructs are effectively prodrugs. For example, if the linker is cleaved by a protease found at the desired site of action, the MVSCA can travel through the body with the adjacent binding site inactive, but upon reaching its site of action (for example, a tumor) the linker is cleaved, the anti-HSA domain is released, and the inhibition of the binding activity of the adjacent domain is reversed. Thus, an anti-HSA domain, when paired with a cleavable linker, constitutes means for reversibly inhibiting the binding activity of an adjacent binding domain in an MVSCA or multi-specific antibody.

Anti-CD47

The function of an anti-CD47 domain is to inhibit the “don't-eat-me” signal of CD47 on tumor cells so that they can be phagocytosed by macrophages. CD47 is widely expressed and anti-CD47 activity can be problematic if there is substantial binding to normal healthy cells. This can be avoided in a couple of ways. There are apparently multiple conformations of CD47 and the conformation commonly found on tumor cells differs from that found, for example, on RBC. As shown in Example 1, the VHH disclosed herein bind CD47 as expressed on tumor cells, but not as expressed on RBC. Avoiding binding to RBC is also important so that the MVSCA isn't captured in the blood stream and prevented from reaching its target.

Another way of avoiding undesirable or detrimental binding of the MVSCA to CD47 can be accomplished by placing it adjacent to an anti-HSA domain in such a manner that binding to CD47 reduced or prevented, as described above. Once the MVSCA binds to a tumor cell through another of its binding domains, and the anti-HSA domain is cleaved by a local protease and released, the anti-CD47 domain can bind CD47 and prevent its phagocytosis-inhibiting interaction with macrophages.

Thus, an anti-CD47 domain constitutes means for reducing inhibition of phagocytosis.

Anti-CD16

The function of an anti-CD16 domain is to up-regulate the ADCC activity of NK cells. Whereas CD16B has a wide tissue distribution, CD16A is specifically expressed in NK cells. Antibodies that are specific for CD16A are preferred because they will bind only to NK cells, the desired target. However, antibodies that bind both CD16A and CD16B and antibodies that bind only to CD16A are both agonists capable of promoting the ADCC activity of NK cells.

CD16 normally interacts with the Fc portion of an antibody. When CD16A on an NK cell is engaged by the Fc portion of an antibody, the cytolytic activity of the NK cell becomes directed against the cell or micro-organism that the variable domains of the antibody have bound. However, there are multiple Fc sequences and multiple types of Fc receptor, leading to multiple possible effects mediated by an Fc region. By using an anti-CD16 domain instead of an Fc region, an MVSCA can specifically recruit NK-mediated ADCC against the target of other specificities it bears. Thus, an anti-CD16 domain constitutes means for recruiting NK-mediated ADCC.

Anti PD-L1

An anti-PD-L1 domain functions both as an immune checkpoint inhibitor and an anti-tumor antigen antibody. Anti-PD-L1 domains act as PD-1 binding antagonists. By blocking PD-L1 (for example, on a tumor cell) from binding to PD-1 (for example, on a T cell), the anti-PD-L1 domain inhibits the associated immune checkpoint, releasing development of a T cell-mediated immune response. PD-1 blockade, using anti-PD-1 or anti-PD-L1 antibodies, is a well-known cancer treatment modality. Thus, an anti-PD-L1 domain constitutes means for PD-1 blockade or means for releasing the PD-1 immune checkpoint.

An anti-PD-L1 domain, as an anti-tumor antigen antibody, can mediate binding of an MVSCA to a tumor cell. If the MVSCA also comprises an anti-CD16 domain NK-mediated ADCC is facilitated. In the MVSCA also comprises an anti-CD47 domain, macrophage-mediated phagocytosis is facilitated. Multivalent binding to the tumor cells improves binding affinity and ADCC. This can be achieved by having multiple copies of the anti-PD-L1 domain and/or one or more binding domains targeting other tumor antigens. Thus an anti-PD-L1 domain constitutes means for binding a tumor cell, means for binding a tumor antigen, or means for binding the PD-L1 tumor antigen.

Anti-LAG3

An anti-LAG3 domain functions as an immune checkpoint inhibitor. Anti-LAG3 domains act as antagonists binding of LAG3 to class II MHC proteins. By blocking LAG3 on a T cell from binding to class II MHC on a tumor cell, the anti-LAG3 domain inhibits the associated immune checkpoint, releasing development of a T cell-mediated immune response. Thus, an anti-LAG3 domain constitutes means for releasing the LAG3 immune checkpoint.

Anti-CD33

An anti-CD33 domain can be used in two ways. Expressed on myeloid and some lymphoid cells, CD33 is expressed in some hematologic cancers, such as acute myeloid leukemia (AML), and is thus a tumor antigen. An anti-CD33 domain, as an anti-tumor antigen antibody, can mediate binding of an MVSCA to a tumor cell. If the MVSCA also comprises an anti-CD16 domain NK-mediated ADCC is facilitated. In the MVSCA also comprises an anti-CD47 domain, macrophage-mediated phagocytosis is facilitated. Multivalent binding to the tumor cells improves binding affinity and ADCC. This can be achieved by having multiple copies of the anti-CD33 domain and/or one or more binding domains targeting other tumor antigens. Thus an anti-CD33 domain constitutes means for binding a tumor cell, means for binding a tumor antigen, or means for binding the CD33 tumor antigen.

Additionally, when CD33 engages sialic acid residues, for example in B-amyloid or other glycoprotein of glycolipid depositions, an inhibitory signaling cascade leads to inhibition of, phagocytic activity. An antibody comprising an anti-CD33 domain can act as an antagonist of CD33 stimulation, thereby promoting phagocytic activity and clearance of β-amyloid, so as to treat Alzheimer's disease. Retinal diseases, such as dry age-related macular degeneration (AMD), also involve insoluble deposits that could be cleared by microglial phagocytosis. Accordingly, an antibody comprising an anti-CD33 domain can also be useful in the treatment of dry AMD and other retinal diseases. Thus, an anti-CD33 domain constitutes means for promoting phagocytic activity (in CD33-expressing cells), means for promoting clearance of β-amyloid, or means for clearance of insoluble deposits.

MVSCA appropriate for treatment of Alzhiemer's disease and retinal diseases are preferably bivalent for CD33 and comprise an anti-HSA domain to improve half-life. They may also comprise an FC5 nanobody domain (Rissiek et al., Front. Cell. Neurosci. 8:344, 2014) to facilitate transmigration across human blood-brain-barrier.

Linkers

In many embodiments, the individual binding domains are not joined directly to each other, but have a short amino acid sequence interposed between them, a linker. Examples of linkers are shown in Table 15. The length and sequence of the linker can have substantial effects on the expression level, and structure of the MVSCA, and the binding affinity of the linked domains. The adjustable length linkers L2 and L4 (see Table 15) can be used to optimize the MVSCA in terms of these parameter. Linkers L1, L2, and L4 may be termed non-cleavable linker means, flexible linker means, or flexible, non-cleavable linker means.

When two copies of the same VHH domain are placed adjacent to each other in a MVSCA the frequently interact detrimentally with each other. This can be avoided by interposing a relatively short and rigid linker between the two copies. In some embodiments, the short, rigid linker has the sequence AAA (L3 in Table 15). Such linkers may be termed short, rigid linker means or non-cleavable short, rigid linker means.

When an anti-HSA domain-HSA complex is being used to generate a prodrug with respect to the binding activity of an adjacent binding domain, a cleavable linker should be interposed between the two domains. L11*3 through L11*18 (see Table 15) are examples of cleavable linkers of various lengths and susceptibility to cleavage by different proteases that can be used to optimize the MVSCA in terms of expression level, and structure of the MVSCA, the binding affinity of the linked domains, and cleavage. Linkers L11*3 through L11*18 may be termed cleavable linker means, flexible linker means, or flexible, cleavable linker means.

MVSCAs

The binding domains and linkers described herein can be combined to create multifunctional MVSCA, adapted for the treatment of particular diseases. They can also be further combined with other binding domains. The MVSCA can also be referred to as comprising means for accomplishing the various functions associated with each component type of binding domain and/or comprising linker means for accomplishing their associated functions. Exemplary designs are briefly discussed immediately below.

HSA/CD47/PD-L1: This design is suitable for treating PD-L1-expressing tumors, will promote phagocytosis, will release the PD-1 immune checkpoint, and will have extended half-life in circulation. In various embodiments, the MVSCA can be bivalent for the anti-CD47 and/or the anti-PD-L1 binding domain(s). Depending on the linker used, the anti-HSA domain (once HSA is bound) will or will not inhibit binding to CD47, and the inhibition, if present, can be reversed by cleavage of a cleavable linker. In some embodiments, the binding domains are arrayed in a different order, but the anti-HSA domain should be in a terminal position if it is to be cleaved. In addition to describing an MVSCA of this design as comprising means for one of more of the functions of its component parts, the MVSCA can also be referred to as means for promoting phagocytosis of PD-L1-expressing tumors (and releasing the PD-1 immune checkpoint). Several embodiments of this design are set out in Example 7.

HSA/LAG3/PD-L1: This design is suitable for treating PD-L1-expressing tumors, will release the LAG3 and PD-1 immune checkpoints, and will have extended half-life in circulation. In various embodiments, the MVSCA can be bivalent for the anti-LAG3 and/or the anti-PD-L1 binding domain(s). In some embodiments, the binding domains are arrayed in a different order. In addition to describing an MVSCA of this design as comprising means for one of more of the functions of its component parts, the MVSCA can also be referred to as means for recruiting T effector cells to PD-L1-expressing tumors (and releasing the LAG3 and PD-1 immune checkpoints). Several embodiments of this design are set out in Example 7.

CD16A/HSA/CD47/PD-L1: This design is suitable for treating PD-L1-expressing tumors, will promote phagocytosis, will recruit NK cells to mediate ADCC, will release the PD-1 immune checkpoint, and will have extended half-life in circulation. In various embodiments, the MVSCA can be bivalent for the anti-CD47 and/or the anti-PD-L1 binding domain(s). In some embodiments, the binding domains are arrayed in a different order, but the anti-HSA domain should be placed in a terminal position if it is to be cleaved. Depending on the linker used, the anti-HSA domain (once HSA is bound) will or will not inhibit binding to CD47, and the inhibition, if present, can be reversed by cleavage of a cleavable linker. In addition to describing an MVSCA of this design as comprising means for one of more of the functions of its component parts, the MVSCA can also be referred to as means for promoting phagocytosis of and recruiting NK-mediated ADCC to PD-L1-expressing tumors (and releasing the PD-1 immune checkpoint). Several embodiments of this design are set out in Example 8.

CD16A/HSA/CD47/CD33: This design is suitable for treating CD33-expressing tumors, will promote phagocytosis, will recruit NK cells to mediate ADCC, and will have extended half-life in circulation. In various embodiments, the MVSCA can be bivalent for the anti-CD47 and/or the anti-CD33 binding domain(s). In some embodiments, the binding domains are arrayed in a different order, but the anti-HSA domain should be placed in a terminal position if it is to be cleaved. Depending on the linker used, the anti-HSA domain (once HSA is bound) will or will not inhibit binding to CD47, and the inhibition, if present, can be reversed by cleavage of a cleavable linker. In addition to describing an MVSCA of this design as comprising means for one of more of the functions of its component parts, the MVSCA can also be referred to as means for promoting phagocytosis of and recruiting NK-mediated ADCC to CD33-expressing tumors. Several embodiments of this design are set out in Example 8.

Bivalent Anti-CD33 MVSCA: These designs are suitable for treating diseases associated with deposition of insoluble material by blocking inhibition of phagocytosis, for example, by microglial cells. Such diseases include Alzheimer's disease and dry AMD. An HSA/CD33/CD33 design will have an extended half-life in circulation. An FC5/CD33/CD33 design will cross the blood-brain barrier. An FC5/CD33/CD33/HAS design will both will have an extended half-life in circulation and cross the blood-brain barrier. A simple CD33/CD33 design is suitable for local injection into the eye or brain, in which case an extended half-life in circulation or ability to cross the blood-brain barrier are of negligible value. In some embodiments, the binding domains are arrayed in a different order. In addition to describing an MVSCA of this design as comprising means for one of more of the functions of its component parts, the MVSCA can also be referred to as means for promoting (microglial) phagocytosis of insoluble deposits. Several embodiments of this design are set out in Example 9.

Use of the Disclosed Antibodies

The disclosed antibodies are useful in medicine. The terms "treatment" "treating", etc., refer to the medical management of a patient with the intent to cure, ameliorate, stabilize, or prevent a disease, pathological condition, or disorder. This term includes active treatment, that is, treatment directed specifically toward the improvement of a disease, pathological condition, or disorder, and also includes causal treatment, that is, treatment directed toward removal of the cause of the associated disease, pathological condition, or disorder. In addition, this term includes palliative treatment, that is, treatment designed for the relief of symptoms rather than the curing of the disease, pathological condition, or disorder; preventative treatment, that is, treatment directed to minimizing or partially or completely inhibiting the development of the associated disease, pathological condition, or disorder; and supportive treatment, that is, treatment employed to supplement another specific therapy directed toward the improvement of the associated disease, pathological condition, or disorder. Various embodiments may specifically include or exclude one or more of these modes of treatment.

Use of the herein disclosed antibodies in diagnostics and imaging is also contemplated.

Further, the term "treating" or "treatment" broadly includes any kind of treatment activity, including the diagnosis, mitigation, or prevention of disease, or aspect thereof, in man or other animals, or any activity that otherwise affects the structure or any function of the body of man or other animals. Treatment activity includes the administration of the medicaments, dosage forms, and pharmaceutical compositions described herein to a patient, especially according to the various methods of treatment disclosed herein, whether by a healthcare professional, the patient his/herself, or any other person. Treatment activities include the orders, instructions, and advice of healthcare professionals such as physicians, physician's assistants, nurse practitioners, and the like, that are then acted upon by any other person including other healthcare professionals or the patient him/herself. This includes, for example, direction to the patient to undergo, or to a clinical laboratory to perform, a diagnostic procedure, such as for cancer diagnosis and staging, so that ultimately the patient may receive the benefit appropriate treatment. In some embodiments, the orders, instructions, and advice aspect of treatment activity can also include encouraging, inducing, or mandating that a particular medicament, or combination thereof, be chosen for treatment of a condition—and the medicament is actually used—by approving insurance coverage for the medicament, denying coverage for an alternative medicament, including the medicament on, or excluding an alternative medicament, from a drug formulary, or offering a financial incentive to use the medicament, as might be done by an insurance company or a pharmacy benefits management company, and the like. In some embodiments, treatment activity can also include encouraging, inducing, or mandating that a particular medicament be chosen for treatment of a condition—and the medicament is actually used—by a policy or practice standard as might be established by a hospital, clinic, health maintenance organization, medical practice or physicians group, and the like. All such orders, instructions, and advice are to be seen as conditioning receipt of the benefit of the treatment on compliance with the instruction. In some instances, a financial benefit is also received by the patient for compliance with such orders, instructions, and advice. In some instances, a financial benefit is also received by the healthcare professional for compliance with such orders, instructions, and advice.

The disclosed monospecific HCAb and multivalent single chain antibodies having specificity for CD47, HSA, PD-L1, CD33, CD16, and LAG3 are useful for treating cancer. Each antibody is designed for treatment for a specific class of cancers based on the antigen-binding specificities included in the antibody.

The present disclosure provides a method of treating cancer comprising administering to a patient in need of such treatment an effective amount of an antibody disclosed herein or a pharmaceutical composition comprising said antibody.

Examples of cancers which can be treated by the disclosed methods include acute lymphoblastic leukemia; acute myeloid leukemia; adrenocortical carcinoma; AIDS-related lymphoma; AIDS-related malignancies; anal cancer; astrocytoma; bile duct cancer, bladder cancer; bone cancer; brain stem glioma; brain tumor; breast cancer; bronchial adenomas/carcinoids; carcinoid tumor; islet cell carcinoma; carcinoma of unknown primary; central nervous system lymphoma; cerebellar astrocytoma; cerebral astrocytoma/malignant glioma; cervical cancer; chronic lymphocytic leukemia; chronic myelogenous leukemia; chronic myeloproliferative disorders; colon cancer; colorectal cancer; cutaneous T-cell lymphoma; endometrial cancer, ependymoma; ovarian epithelial cancer; esophageal cancer; Ewing's family of tumors; extracranial germ cell tumor; intraocular melanoma; retinoblastoma; gallbladder cancer; gastric cancer; germ cell tumor; gestational trophoblastic tumor; hairy cell leukemia; head and neck cancer; hepatocellular cancer; Hodgkin's lymphoma; hypopharyngeal cancer; Kaposi's sarcoma; kidney cancer; laryngeal cancer; non-small cell lung cancer; small cell lung cancer; non-Hodgkin's lymphoma; Waldenstrom's macroglobulinemia; malignant mesothelioma; malignant thymoma; medulloblastoma; melanoma; Merkel cell carcinoma; squamous neck cancer; multiple endocrine neoplasia syndrome; multiple myeloma/plasma cell neoplasm; mycosis fungoides; myelodysplastic syndromes; nasopharyngeal cancer; neuroblastoma; oral cancer; oropharyngeal cancer; osteosarcoma; pancreatic cancer; parathyroid cancer; penile cancer; pheochromocytoma; pituitary tumor; pleuropulmonary blastoma; prostate cancer; rectal cancer; rhabdomyosarcoma; salivary gland cancer; soft tissue sarcoma; Sezary syndrome; skin cancer; squamous neck cancer; testicular cancer; thymoma; thyroid cancer; trophoblastic tumor; urethral cancer; uterine cancer; vaginal cancer; vulvar cancer; and Wilms' tumor.

The effectiveness of cancer therapy is typically measured in terms of "response." The techniques to monitor responses can be similar to the tests used to diagnose cancer such as, but not limited to:

A lump or tumor involving some lymph nodes can be felt and measured externally by physical examination.

Some internal cancer tumors will show up on an x-ray or CT scan and can be measured with a ruler.

Blood tests, including those that measure organ function can be performed.

A tumor marker test can be done for certain cancers.

Regardless of the test used, whether blood test, cell count, or tumor marker test, it is repeated at specific intervals so that the results can be compared to earlier tests of the same type.

Response to cancer treatment is defined several ways:

Complete response—all of the cancer or tumor disappears; there is no evidence of disease. Expression level of tumor marker (if applicable) may fall within the normal range.

Partial response—the cancer has shrunk by a percentage but disease remains. Levels of a tumor marker (if applicable) may have fallen (or increased, based on the tumor marker, as an indication of decreased tumor burden) but evidence of disease remains.

Stable disease—the cancer has neither grown nor shrunk; the amount of disease has not changed. A tumor marker (if applicable) has not changed significantly.

Disease progression—the cancer has grown; there is more disease now than before treatment. A tumor marker test (if applicable) shows that a tumor marker has risen.

Other measures of the efficacy of cancer treatment include intervals of overall survival (that is time to death from any cause, measured from diagnosis or from initiation of the treatment being evaluated)), cancer-free survival (that is, the length of time after a complete response cancer remains undetectable), and progression-free survival (that is, the length of time after disease stabilization or partial response that resumed tumor growth is not detectable).

There are two standard methods for the evaluation of solid cancer treatment response with regard to tumor size (tumor burden), the WHO and RECIST standards. These methods measure a solid tumor to compare a current tumor with past measurements or to compare changes with future measurements and to make changes in a treatment regimen. In the WHO method, the solid tumor's long and short axes are measured with the product of these two measurements is then calculated; if there are multiple solid tumors, the sum of all the products is calculated. In the RECIST method, only the long axis is measured. If there are multiple solid tumors, the sum of all the long axes measurements is calculated. However, with lymph nodes, the short axis is measured instead of the long axis.

The present disclosure provides a method of treating an ocular disorder comprising administering to a patient in need of such treatment antibody disclosed herein. Exemplary ocular disorders include age-related macular degeneration (AMD), for example wet AMD or dry AMD, or macular edema, for example diabetic macular edema. In some embodiments, the ocular disorder is a retinal disorder.

The present disclosure also provides a method of treating a neurodegenerative disease including, but not limited to, Alzheimer's disease, lewy body disease, Parkinson's disease, multiple sclerosis, amyotrophic lateral sclerosis, leukodystrophy, progressive supranuclear palsy, neuroinflammation, an inflammatory demyelinating disease, dementia, or a neuropathy. In one embodiment, the neurodegenerative disease is Alzheimer's disease.

The following examples, sequence listing, and figures are provided to aid the understanding of the present invention, the true scope of which is set forth in the appended claims. It is understood that modifications can be made in the procedures set forth without departing from the spirit of the invention.

LIST OF PARTICULAR EMBODIMENTS

The following listing of embodiments is illustrative of the variety of embodiments with respect to breadth, combinations and sub-combinations, class of invention, etc., elucidated herein, but is not intended to be an exhaustive enumeration of all embodiments finding support herein.

Embodiment 1. A variable heavy (VHH) domain having an antigen-binding specificity for CD47.

Embodiment 2. The VHH domain of Embodiment 1 having the amino acid sequence of one of SEQ ID NOs: 2-29 or 223.

Embodiment 3. A variable heavy (VHH) domain having an antigen-binding specificity for PD-L1.

Embodiment 4. The VHH domain of Embodiment 3 having the amino acid sequence of one of SEQ ID NOs: 31-38.

Embodiment 5. A variable heavy (VHH) domain having an antigen-binding specificity for human serum albumin (HSA).

Embodiment 6. The VHH domain of Embodiment 5 having the amino acid sequence of one of SEQ ID NOs: 40-48.

Embodiment 7. A variable heavy (VHH) domain having an antigen-binding specificity for CD33.

Embodiment 8. The VHH domain of Embodiment 7 having the amino acid sequence of one of SEQ ID NOs: 50-78.

Embodiment 9. A variable heavy (VHH) domain having an antigen-binding specificity for LAG3.

Embodiment 10. The VHH domain of Embodiment 9 having the amino acid sequence of one of SEQ ID NOs: 80-93.

Embodiment 11. A variable heavy (VHH) domain having an antigen-binding specificity for CD16.

Embodiment 12. The VHH domain of Embodiment 11 having the amino acid sequence of one of SEQ ID NOs: 96-99.

Embodiment 13. A heavy-chain only antibody (HCAb) comprising the VHH domain of any one of Embodiments 1-12.

Embodiment 14. An antibody comprising one or more constant domains and means for binding CD47, HSA, PD-L1, CD33, CD16, or LAG3.

Embodiment 15. A multi-specific antibody comprising one or more of the VHH domains of Embodiments 1-12 or means for binding CD47, HSA, PD-L1, CD33, CD16, or LAG3.

Embodiment 16. The multi-specific antibody of Embodiment 15, further comprising one of more additional antibody binding domains.

Embodiment 17. The multi-specific antibody of Embodiment 16, wherein the additional antibody binding domain comprises FC5 (SEQ ID NO:222).

Embodiment 18. The multi-specific antibody of Embodiment 16, wherein the additional antibody binding domain comprises an Fv or Fab.

Embodiment 19. The multi-specific antibody of any one of Embodiments 15-17 that is a multi-specific single chain antibody (MVSCA).

Embodiment 20. The MVSCA of Embodiment 19 comprising 2, 3, 4, 5, or 6 antibody binding domains.

Embodiment 21. The MVSCA of Embodiment 20 having 1, 2, 3, or 4 antibody binding specificities.

Embodiment 22. The MVSCA of any one of Embodiments 19-21, comprising antibody binding domains recognizing HSA, CD47, and PD-L1.

Embodiment 23. The MVSCA of any one of Embodiments 19-21, comprising antibody binding domains recognizing HSA, CD47, and CD33.

Embodiment 24. The MVSCA of any one of Embodiments 19-21, comprising antibody binding domains recognizing HSA, LAG3, and PD-L1.

Embodiment 25. The MVSCA of any one of Embodiments 19-21, comprising antibody binding domains recognizing HSA, LAG3, and CD33.

Embodiment 26. The MVSCA of any one of Embodiments 19-21, comprising antibody binding domains recognizing CD16, HSA, and PD-L1.

Embodiment 27. The MVSCA of any one of Embodiments 19-21, comprising antibody binding domains recognizing CD16, HSA, and CD33.

Embodiment 28. The MVSCA of any one of Embodiments 19-21, comprising antibody binding domains recognizing CD16, HSA, CD47, and PD-L1.

Embodiment 29. The MVSCA of any one of Embodiments 19-21, comprising antibody binding domains recognizing CD16, HSA, CD47, and CD33.

Embodiment 30. The MVSCA of any one of Embodiments 14-21 or 26-29, wherein the antibody binding domain recognizing CD16, preferentially recognizes CD16A.

Embodiment 31. The MVSCA of any one of Embodiments 19-30, comprising two adjacent antibody binding domains having the same specificity.

Embodiment 32. The MVSCA of Embodiment 31, wherein the two adjacent antibody binding domains having the same specificity have a short, rigid linker means interposed between them.

Embodiment 33. The MVSCA of Embodiment 31, wherein the short, rigid linker means consists of the amino acid sequence AAA (SEQ ID NO: 102).

Embodiment 34. The MVSCA of any one of Embodiments 31-33, wherein the two adjacent antibody binding domains bind CD33.

Embodiment 35. The MVSCA of Embodiment 34, further comprising an antibody binding domain recognizing HSA.

Embodiment 36. The MVSCA of Embodiment 34 or 35, further comprising FC5.

Embodiment 37. The MVSCA of any one of Embodiments 31-33, wherein the two adjacent antibody binding domains bind PD-L1.

Embodiment 38. The MVSCA of any one of Embodiments 31-33, wherein the two adjacent antibody binding domains bind LAG3.

Embodiment 39. The MVSCA of any one of Embodiments 31-33, wherein the two adjacent antibody binding domains bind CD16.

Embodiment 40. The MVSCA of any one of Embodiments 31-33, wherein the two adjacent antibody binding domains bind CD47.

Embodiment 41. The MVSCA of any one of Embodiments 19-30, comprising a linker between adjacent antibody binding domains.

Embodiment 42. The MVSCA of Embodiment 4', wherein the linker interposed between non-identical antigen binding domains is L1 (SEQ ID NO: 100), L2 (SEQ ID NO: 101), or L4 (SEQ ID NO: 103).

Embodiment 43. The MVSCA of any one of Embodiments 19-30, comprising flexible, non-cleavable linker means interposed between non-identical antigen binding domains.

Embodiment 44. The MVSCA of any one of Embodiments 19-30, comprising an N- or C-terminally positioned antibody binding domain that binds HSA.

Embodiment 45. The MVSCA of Embodiment 44, wherein upon binding HSA, the antibody binding domain adjacent to the antibody binding domain that binds HSA is inhibited from binding to its antigen.

Embodiment 46. The MVSCA of Embodiment 45, wherein the antibody binding domain adjacent to the antibody binding domain that binds HSA recognizes CD47.

Embodiment 47. The MVSCA of Embodiment 45 or 46, wherein a cleavable linker is interposed between the antibody binding domain that binds HSA and the antibody binding domain adjacent to it, wherein the cleavable linker is L11*3 (SEQ ID NO: 104), L11*4 (SEQ ID NO: 105), L11*5 (SEQ ID NO: 106), L11*6 (SEQ ID NO:107), L11*7 (SEQ ID NO:108), L11*8 (SEQ ID NO:109), L11*9 (SEQ ID NO:110), L11*10 (SEQ ID NO:111), L11*11 (SEQ ID NO: 112), L11*12 (SEQ ID NO:113), L11*13 (SEQ ID NO:114), L11*14 (SEQ ID NO:115), L11*15 (SEQ ID NO:116), L11*16 (SEQ ID NO:117), L11*17 (SEQ ID NO:118), or L11*18 (SEQ ID NO:119).

Embodiment 48. The MVSCA of Embodiment 45 or 46, wherein cleavable linker means are interposed between the antibody binding domain that binds HSA and the antibody binding domain adjacent to it.

Embodiment 49. The MVSCA of any one of Embodiments 19-48, wherein all of the antibody binding domains are VHH domains.

Embodiment 50. A pharmaceutical composition comprising the VHH domain or antibody of any one of Embodiments 1-49.

Embodiment 51. A pharmaceutical composition comprising means for binding HSA, means for extending multi-specific antibody or MVSCA half-life in the body, means for reversibly inhibiting the binding activity of an adjacent binding domain.

Embodiment 52. A pharmaceutical composition comprising means for binding CD47 or means for reducing inhibition of phagocytosis.

Embodiment 53. A pharmaceutical composition comprising means for binding CD16 or CD16A, or means for recruiting NK-mediated ADCC.

Embodiment 54. A pharmaceutical composition comprising means for binding PD-L1, means for binding the PD-L1 tumor antigen, means for PD-1 blockade, or means for releasing the PD-1 immune checkpoint.

Embodiment 55. A pharmaceutical composition comprising means for binding a tumor antigen, means for binding the PD-L1 tumor antigen, or means for binding the CD33 tumor antigen.

Embodiment 56. A pharmaceutical composition comprising means for binding LAG3 or means for releasing the LAG3 immune checkpoint.

Embodiment 57. A pharmaceutical composition comprising means for releasing an immune checkpoint, means for releasing the PD-1 immune checkpoint, or means for releasing the LAG3 immune checkpoint.

Embodiment 58. A pharmaceutical composition comprising means for binding CD33, means for binding the CD33 tumor antigen, means for promoting clearance of β-amyloid, or means for clearance of insoluble deposits.

Embodiment 59. A pharmaceutical composition comprising means for promoting phagocytosis of PD-L1-expressing tumors.

Embodiment 60. A pharmaceutical composition comprising means for recruiting T effector cells to PD-L1-expressing tumors.

Embodiment 61. A pharmaceutical composition comprising means for promoting phagocytosis of and recruiting NK-mediated ADCC to PD-L1-expressing tumors.

Embodiment 62. A pharmaceutical composition comprising means for promoting phagocytosis of and recruiting NK-mediated ADCC to CD33-expressing tumors.

Embodiment 63. A method of treating cancer comprising administering the antibody of any one of Embodiments 1-48 or pharmaceutical composition of any one of Embodiments 49-61 to a patient in need thereof.

Embodiment 64. A method of treating Alzheimer's disease or a retinal disease comprising administering the antibody of any one of Embodiments 7-8, 13-21, 34-36, or 48-49, wherein the antibody comprises a CD33 binding domain, or the pharmaceutical composition of Embodiment 58, to a patient in need thereof.

Embodiment 65. The method of Embodiment 64, wherein the antibody does not comprise an antibody binding domain recognizing CD47, PD-L1, LAG3, or CD16.

Embodiment 66. The method of Embodiment 64 or 65, wherein the retinal disease is dry AMD.

For each of Embodiments 63-66 there are corresponding embodiments of a composition for use in treatment, a composition for use in manufacture of a medicament, use of a composition in treatment, and use of a composition in the manufacture of a medicament.

EXAMPLES

Example 1. Anti-CD47 HCAb Antibodies

Isolation of Anti-CD47 HCAb Antibody from Immunized Llamas.

Immunizations. Two llamas were immunized at Abcore Inc (Ramona, CA) following their standard protocols. Recombinant human CD47 (extracellular domain 19-139, SEQ ID NO:1) were mixed with Complete Freund's Adjuvant (day 0) or Incomplete Freund's Adjuvant (following immunizations) (Difco, BD Biosciences). Six subcutaneous injections per llama was performed at 50 μg/dose at biweekly intervals. At day 45, serum was collected from llamas immunized with recombinant CD47 protein to determine antibody titers against hCD47 by ELISA. In ELISA, 96-well MAXISORP™ plates (Nunc) were coated with 100 ng/well hCD47. After blocking and adding diluted sera samples, the presence of anti-CD47 antibodies was demonstrated using horseradish peroxidase (HRP)-conjugated goat anti-llama IgG (H+L) antibody (Invitrogen).

```
Extracellular domain of human CD47 (19-139,
Q08722)
                                    SEQ ID NO: 1
QLLFNKTKSVEFTFCNDTVVIPCFVTNMEAQNTTEVYVKWKFKGRDIYT

FDGALNKSTVPTDFSSAKIEVSQLLKGDASLKMDKSDAVSHTGNYTCEV

TELTREGETIIELKYRVVSWFSP
```

Phage library construction and selection. Peripheral blood mononuclear cells were prepared from day 45 blood samples from llamas immunized with recombinant CD47 protein using FICOLL-PAQUER Plus (GE Healthcare) density gradient media according to the manufacturer's instructions. Total RNA was extracted from the peripheral blood mononuclear cells using RNEASY® Midi Kit (Qiagen) following manufacturer instructions and used as starting material for RT-PCR to amplify VHH encoding gene fragments. These fragments were cloned into a phagemid vector, allowing production of recombinant phage particles, after infection with helper phage, which display the VHH as gene-Ill fusion proteins on the surface of the phage particles. Phage was prepared according to standard methods and stored after filter sterilization at 4° C. for further use.

For selection of CD47-binding phage, biotinylated CD47 was incubated with the phage libraries and subsequently captured on streptavidin DYNABEADS® (Invitrogen). Following extensive washing, bound phage were eluted with 1 mg/ml trypsin. The output from the selections was rescued in *E. coli* TG1 cells. Colonies were picked and sequenced at BATJ, Inc. (San Diego, CA).

cDNAs encoding CD47-binding VHH were synthesized with C-terminal His-tag at Atum (Newark, CA), and transiently transfected in HEK293 cells, and positive VHH were purified by IMAC chromatography.

CD47-binding phage colonies from immunized llama phage libraries were sequenced and their amino acid sequences, listed below (Table 2), determined for each VHH. cDNA sequences based on amino acid sequences below were fused with human Fc and synthesized in pJ607 expression vector. The expression plasmids were transfected into a HEK293 cell line to produce recombinant anti-CD47 HCAb antibodies. The expressed anti-CD47 HCAbs were purified by HITRAP® protein A column.

The A09-10 VHH was humanized based on IGHV3-23 human germline sequences.

TABLE 2

| Llama anti-CD47 VHH Sequences | |
|---|---|
| A09-08 (SEQ ID NO: 2) | QVQLVESGGGLVQAGGSLRLSCAASGYGVNSYALGWFRQAPGKEREFVAAISRSGGN INYADSAKGRFTISRDNFKNTTYLQMSSLKPEDTAVYYCAAHYLLLPSYISTSTNMY NYWGQGTQVTVSS |

TABLE 2-continued

| Llama anti-CD47 VHH Sequences | |
|---|---|
| A09-31<br>(SEQ ID NO: 3) | QVQLVESGGGLVQAGGSLRLSCAASGYGVNSYALGWFRQAPGKEREFVAAISRSGGN<br>INYADSAKGRFTISRDNFKNTTYLQMSSLKPEDTAVYYCAAHYLLLPSYIATAIKMY<br>NYWGQGTQVTVSS |
| A09-61<br>(SEQ ID NO: 4) | QVQLVESGGGLVQAGGSLRLSCAASGYGVNSYALGWFRQAPGKEREFVAAISRSGGN<br>INYADSAKGRFTISRDNFKNTTYLQMSSLKPEDTAVYYCAAHYLLLPSYISFASKMY<br>NYWGQGTQVTVSS |
| A09-004<br>(SEQ ID NO: 5) | QVQLVESGGGLVQAGGSLRLSCAASGGVMWSSALGWFRQAPGKEREFVAAISRSGGN<br>INYADSAKGRFTISRDNFKNTTYLQMSSLKPEDTAVYYCAAHYLLLPSYISTSTNMY<br>NYWGQGTQVTVSS |
| A09-006<br>(SEQ ID NO: 6) | QVQLVESGGGLVQAGGSLRLSCAASGIRFFGSALGWFRQAPGKEREFVAAISRSGGN<br>INYADSAKGRFTISRDNFKNTTYLQMSSLKPEDTAVYYCAAHYLLLPSYISTSTNMY<br>NYWGQGTQVTVSS |
| A09-10<br>(SEQ ID NO: 7) | QVQLVESGGGLVQAGGSLRLSCAASGGGRTFSNYALGWFRQAPGKEREFVAAISRSG<br>GNINYADSAKGRFTISRDNFKNTTYLQMSSLKPEDTAVYYCAAHYLLLPSYISTSTN<br>MYNYWGQGTQVTVSS |
| hA09-10<br>(SEQ ID NO: 8 ) | EVQLVESGGGLVQPGGSLRLSCAASGGGRTFSNYALGWFRQAPGKEREFVAAISRSG<br>GNINYADSVKGRFTISRDNAKNTVYLQMSSLRAEDTAVYYCAAHYLLLPSYISTSTN<br>MYNYWGQGTQVTVSS |
| hA09-10-1<br>(SEQ ID NO: 9) | QVQLVESGGGLVQPGGSLRLSCAASGGGRTFSNYALGWFRQAPGKEREFVAAISRSG<br>GNINYADSVKGRFTISRDNAKNTVYLQMSSLRAEDTAVYYCAAHYLLLPSYISTSTN<br>MYNYWGQGTQVTVSS |
| hA09-10-2<br>(SEQ ID NO: 10) | EVQLVESGGGLVQPGGSLRLSCAASGGGRTFSNYALGWFRQAPGKEREFVAAISRSG<br>GNINYADSVKGRFTISRDNFKNTTYLQMSSLKPEDTAVYYCAAHYLLLPSYISTSTN<br>MYNYWGQGTQVTVSS |
| hA09-10-3<br>(SEQ ID NO: 11) | EVQLVESGGGLVQPGGSLRLSCAASGGGRTFSNYALGWFRQAPGKEREFVAAISRSG<br>GNINYADSVKGRFTISRDNFKNTVYLQMSSLRAEDTAVYYCAAHYLLLPSYISTSTN<br>MYNYWGQGTQVTVSS |
| hA09-10-4<br>(SEQ ID NO: 12) | QVQLVESGGGLVQPGGSLRLSCAASGGGRTFSNYALGWFRQAPGKEREFVAAISRSG<br>GNINYADSVKGRFTISRDNAKNTVYLQMSSLRAEDTAVYYCAAHYLLLPSYISTSTN<br>MYNYWGQGTQVTVSS |
| hA09-10-45<br>(Biv)*<br>(SEQ ID NO: 13) | EVQLVESGGGVVRPGGSLRLSCAASGGGRTFSNYAMGWFRQAPGKEREFVSAISRSG<br>GNIYYADSVKGRFTISRDNFKNTVYLQMSSLRAEDTAVYYCAAHYLLLPSYISTSTN<br>MYNYWGQGTQVTVSSAAAQVQLVESGGGVVRPGGSLRLSCAASGGGRTFSNYAMGWF<br>RQAPGKEREFVSAISRSGGNIYYADSVKGRFTISRDNAKNTVYLQMSSLRAEDTAVY<br>YCAAHYLLLPSYISTSTNMYNYWGQGTQVTVSS |
| hA09-10-5<br>(SEQ ID NO: 14) | QVQLVESGGGLVQPGGSLRLSCAASGGGRTFSNYALGWFRQAPGKEREFVAAISRSG<br>GNINYADSVKGRFTISRDNSKNTLYLQMSSLRAEDTAVYYCAAHYLLLPSYISTSTN<br>MYNYWGQGTQVTVSS |
| hA09-10-55<br>(Biv)<br>(SEQ ID NO: 15) | EVQLVESGGGVVRPGGSLRLSCAASGGGRTFSNYAMGWFRQAPGKEREFVSAISRSG<br>GNIYYADSVKGRFTISRDNSKNTLYLQMSSLEPEDTAVYYCAAHYLLLPSYISTSTN<br>MYNYWGQGTQVTVSSAAAQVQLVESGGGVVRPGGSLRLSCAASGGGRTFSNYAMGWF<br>RQAPGKEREFVSAISRSGGNIYYADSVKGRFTISRDNSKNTLYLQMSSLEPEDTAVY<br>YCAAHYLLLPSYISTSTNMYNYWGQGTQVTVSS |
| hA09-10-6<br>(SEQ ID NO: 16) | AAAQVQLVESGGGLVQPGGSLRLSCAASGGGRTFSNYALGWFRQAPGKEREFVSAIS<br>RSGGNIDYADSVKGRFTISRDNAKNTVYLQMSSLRAEDTAVYYCAAHYLLLPSYIST<br>STNMYNYWGQGTQVTVSS |
| hA09-10-66<br>(Biv)<br>(SEQ ID NO: 17) | EVQLVESGGGLVQPGGSLRLSCAASGGGRTFSNYALGWFRQAPGKEREFVSAISRSG<br>GNIDYADSVKGRFTISRDNFKNTVYLQMSSLRAEDTAVYYCAAHYLLLPSYISTSTN<br>MYNYWGQGTQVTVSSAAAQVQLVESGGGLVQPGGSLRLSCAASGGGRTFSNYALGWF<br>RQAPGKEREFVSAISRSGGNIYYADSVKGRFTISRDNAKNTVYLQMSSLRAEDTAVY<br>YCAAHYLLLPSYISTSTNMYNYWGQGTQVTVSS |
| hA09-10-7<br>(SEQ ID NO: 18) | QVQLVESGGGLVQPGGSLRLSCAASGGGRTFSNYALGWFRQAPGKEREFVSAISRSG<br>GNIDYADSVKGRFTISRDNSKNTLYLQMSSLKPEDTAVYYCAAHYLLLPSYISTSTN<br>MYNYWGQGTQVTVSS |
| hA09-10-77<br>(Biv)<br>(SEQ ID NO: 19) | EVQLVESGGGLVQPGGSLRLSCAASGGGRTFSNYALGWFRQAPGKEREFVSAISRSG<br>GNIDYADSVKGRFTISRDNSKNTLYLQMSSLKPEDTAVYYCAAHYLLLPSYISTSTN<br>MYNYWGQGTQVTVSSAAAQVQLVESGGGLVQPGGSLRLSCAASGGGRTFSNYALGWF<br>RQAPGKEREFVSAISRSGGNIDYADSVKGRFTISRDNSKNTLYLQMSSLKPEDTAVY<br>YCAAHYLLLPSYISTSTNMYNYWGQGTQVTVSS |

TABLE 2-continued

| Llama anti-CD47 VHH Sequences | |
|---|---|
| hA09-10-8<br>(SEQ ID NO: 20) | QVQLVESGGGLVQPGGSLRLSCAASGGGRTFSNYALGWFRQAPGKEREFVSAISRSG<br>GNIYYADSVKGRFTISRDNSKNTLYLQMSSLKPEDTAVYYCAAHYLLLPSYISTSTN<br>MYNYWGQGTQVTVSS |
| hA09-10-88<br>(Biv)<br>(SEQ ID NO: 21) | EVQLVESGGGLVQPGGSLRLSCAASGGGRTFSNYALGWFRQAPGKEREFVSAISRSG<br>GNIYYADSVKGRFTISRDNSKNTLYLQMSSLKPEDTAVYYCAAHYLLLPSYISTSTN<br>MYNYWGQGTQVTVSSAAAQVQLVESGGGLVQPGGSLRLSCAASGGGRTFSNYALGWF<br>RQAPGKEREFVSAISRSGGNIYYADSVKGRFTISRDNSKNTLYLQMSSLKPEDTAVY<br>YCAAHYLLLPSYISTSTNMYNYWGQGTQVTVSS |
| hA09-10-9<br>(SEQ ID NO: 22) | QVQLVESGGGLVQPGGSLRLSCAASGGGRTFSNYAMSWVRQAPGKEREFVSAISRSG<br>GNIYYADSVKGRFTISRDNSKNTLYLQMSSLKPEDTAVYYCAAHYLLLPSYISTSTN<br>MYNYWGQGTQVTVSS |
| hA09-10-99<br>(Biv)<br>(SEQ ID NO: 23) | EVQLVESGGGLVQPGGSLRLSCAASGGGRTFSNYAMGWFRQAPGKEREFVSAISRSG<br>GNIYYADSVKGRFTISRDNSKNTLYLQMSSLKPEDTAVYYCAAHYLLLPSYISTSTN<br>MYNYWGQGTQVTVSSAAAQVQLVESGGGLVQPGGSLRLSCAASGGGRTFSNYAMGWF<br>RQAPGKEREFVSAISRSGGNIYYADSVKGRFTISRDNSKNTLYLQMSSLKPEDTAVY<br>YCAAHYLLLPSYISTSTNMYNYWGQGTQVTVSS |
| hA09-10-10<br>(SEQ ID NO: 24) | QVQLVESGGGLVQPGGSLRLSCAASGGGRTFSNYAMSWVRQAPGKEREFVSAISRSG<br>GNIYYADSVKGRFTISRDNSKNTLYLQMSSLRAEDTAVYYCAAHYLLLPSYISTSTN<br>MYNYWGQGTQVTVSS |
| hA09-10-100<br>(Biv)<br>(SEQ ID NO: 25) | EVQLVESGGGLVQPGGSLRLSCAASGGGRTFSNYAMGWFRQAPGKEREFVSAISRSG<br>GNIYYADSVKGRFTISRDNSKNTLYLQMSSLRAEDTAVYYCAAHYLLLPSYISTSTN<br>MYNYWGQGTQVTVSSAAAQVQLVESGGGLVQPGGSLRLSCAASGGGRTFSNYAMGWF<br>RQAPGKEREFVSAISRSGGNIYYADSVKGRFTISRDNSKNTLYLQMSSLRAEDTAVY<br>YCAAHYLLLPSYISTSTNMYNYWGQGTQVTVSS |
| hA09-10-11<br>(SEQ ID NO: 26) | QVQLVESGGGLVQPGGSLRLSCAASGGGRTFSNYAMSWVRQAPGKEREFVSAISRSG<br>GNIYYADSVKGRFTISRDNAKNTVYLQMSSLRAEDTAVYYCAAHYLLLPSYISTSTN<br>MYNYWGQGTQVTVSS |
| hA09-10-12<br>(SEQ ID NO: 27) | QVQLVESGGGLVQPGGSLRLSCAASGGGRTFSNYAMSWVRQAPGKEREFVSAISRSG<br>GNIYYADSVKGRFTISRDNSKNTLYLQMSSLKPEDTAVYYCAAHYLLLPSYISTSTN<br>MYNYWGQGTQVTVSS |
| hA09-10-13<br>(SEQ ID NO: 28) | QVQLVESGGGLVQPGGSLRLSCAASGGGRTFSNYAMSWVRQAPGKEREFVSAISRSG<br>GNIYYADSVKGRFTISRDNAKNTVYLQMSSLKPEDTAVYYCAAHYLLLPSYISTSTN<br>MYNYWGQGTQVTVSS |
| hA09-10-14<br>(SEQ ID NO: 29) | QVQLVESGGGLVQPGGSLRLSCAASGGGRTFSNYAMSWVRQAPGKEREFVSAISRSG<br>GNIYYADSVKGRFTISRDNSKNTLYLQMSSLRAEDTAVYYCAAHYLLLPSYISTSTN<br>MYNYWGQGTQVTVSS |
| hA09-10-30<br>(SEQ ID NO: 223) | EVQLVESGGGLVQPGGSLRLSCAASGGGRTFSNYALGWFRQAPGKEREFVAAISRSG<br>GNINYADSVKGRFTISRDNAKNTVYLQMSSLEPEDTAVYYCAAHYLLLPSYISTSTN<br>MYNYWGQGTQVTVSS |

*Biv = bivalent

The VHH of Table 2 constitute means for binding CD47.

OCTET® Binding Analysis of Anti-CD47 HCAb Molecules

Bio-Layer Interferometry (BLI), a label-free technology, was used for measuring the binding kinetics of human CD47 (R & D systems) with anti-CD47 VHH. Affinity measurements were performed with OCTET® $QK^e$ equipped with Anti-Penta-His capture (HIS1K) biosensor tips (FORTEBIO®). The assay was performed at 30 C in 1×PBS buffer (GIBCO®, PBS pH 7.2). Samples were agitated at 1000 rpm. Prior to analysis, sensors were humidified for 15 min. Purified anti-CD47 VHH was tested for its binding capacity with HIS1K sensor tips. Tips were loaded using 20 μg/ml of anti-CD47 VHH. Loading proceeded for 300 sec resulting in capture levels of between 1.8 and 2 nm. Human CD47 antigen were prepared for binding analysis by dilution to concentrations of 100, 150, 250, 350 nM in 1×PBS. Association was initiated and monitored for 200 sec, after which tips were transferred to 1×PBS buffer (GIBCO®, PBS pH 7.2), in order to monitor dissociation. Sensor data was collected throughout the experiments, processed, and analyzed using the OCTET® data analysis software 7 (FORTEBIO®).

OCTET® kinetic analysis of binding affinity of anti-CD47 HCAb is listed in Table 3. HCAbs A09-04, A09-06, A09-08, and A09-10 exhibit pM binding affinity.

TABLE 3

OCTET ® kinetic analysis of binding affinity ($K_D$) of anti-CD47 HCAb

| VHH | $K_{on}$ (1/Ms) | $K_{off}$ (1/s) | $K_D$ (M) |
|---|---|---|---|
| A09-08 | 3.33E+04 | 2.10E−06 | 6.30E−011 |
| A09-31 | 2.75E+04 | 5.22E−04 | 1.90E−08 |
| A09-61 | 6.21E+04 | 1.10E−04 | 1.77E−09 |
| A09-04 | 1.10+05 | 2.98E−04 | 2.71E−011 |
| A09-06 | 8.70E+04 | 1.09E−06 | 1.14E−011 |
| A09-10 | 4.27E+04 | 1.14E−06 | 2.67E−011 |
| hA09-10 | 3.98E+04 | 1.10E−06 | 2.76E−11 |

Flow Cytometry Analysis of Binding Affinity of Anti-CD47 HCAb on CD47 Overexpressing CHO Cell Line.

$1\times10^6$ cells/ml of CD47-overexpressing CHO cells in ice cold FACS Buffer (PBS, 1% BSA, 0.1% $NaN_3$) were incubated with anti-CD47 HCAbs or B6H12 anti-CD47 antibody as a control in a concentration range from 100 nM to 0.00128 nM and incubated for 45 min on ice. The cells were washed with FACS Buffer and added goat anti-human IgG Fc, FITC conjugate antibody (ThermoFisher) according to manufacturer's instructions, and then incubated for 30 min at 4° C. Data were acquired using GUAVA® EASYCYTE™ HT flow cytometer.

Following the flow cytometric methods described above, binding affinity for anti-CD47 HCAbs was determined as $EC_{50}$ depicted in FIG. 1.

Figure 2:
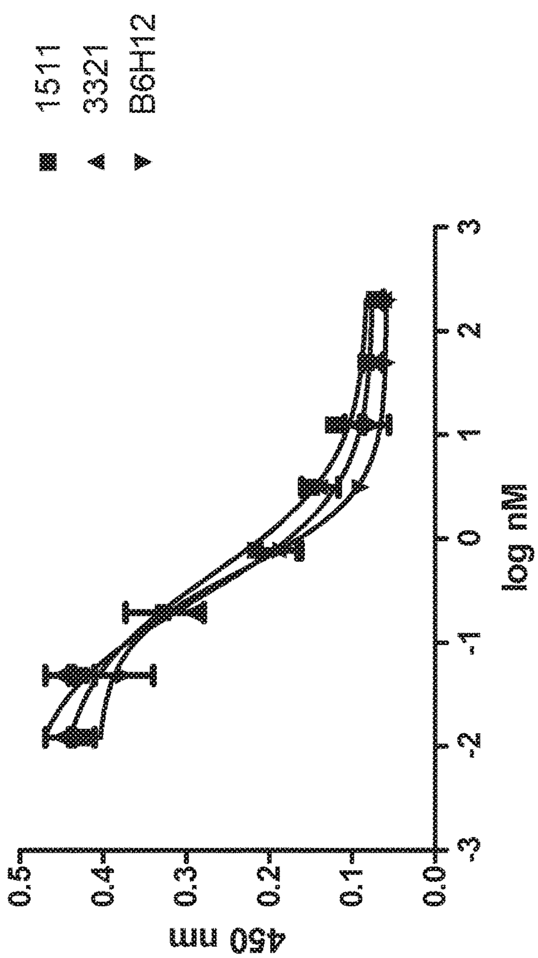
FIG. 2 depicts competitive ELISA binding analysis of the multi-specific antibodies 1511 (SEQ ID NO: 156) and 3321 (SEQ ID NO: 159) with binding specificity for CD47.

Competitive ELISA Binding Analysis of Multi-Specific Molecules with Anti-CD47 Domain The competitive ELISA binding assay was performed to screen CD47-binding multi-specific molecules 1511 (SEQ ID NO 156; CD16F-L1-HSA-L1-CD47-L3-CD47-L1-PDL1-L3-PDL1) and 3321 (SEQ ID NO 159; CD16F-L1-HSA-L1-CD47-L1-CD33-L3-CD33), both containing the anti-CD47 VHH A09-10 which competitively blocks CD47 antigen binding to its receptor SIRPα. Multi-specific antibodies are identified by their binding domain (i.e., CD47) and linkers separating the binding domains (i.e., L1 as identified in Table 15). One hundred nanograms per well of CD47-Fc (R&D systems) was coated on a 96 well plate, 10 nM biotinylated human SIRPα was pre-incubated with multi-specific molecules 1511 and 3321 at different concentrations and then HRP-conjugated streptavidin was added. Multi-specific molecules 1511 and 3321 competitively blocked CD47 binding to its receptor SIRPα at $EC_{50}$ depicted in FIG. 2.

Figure 3:
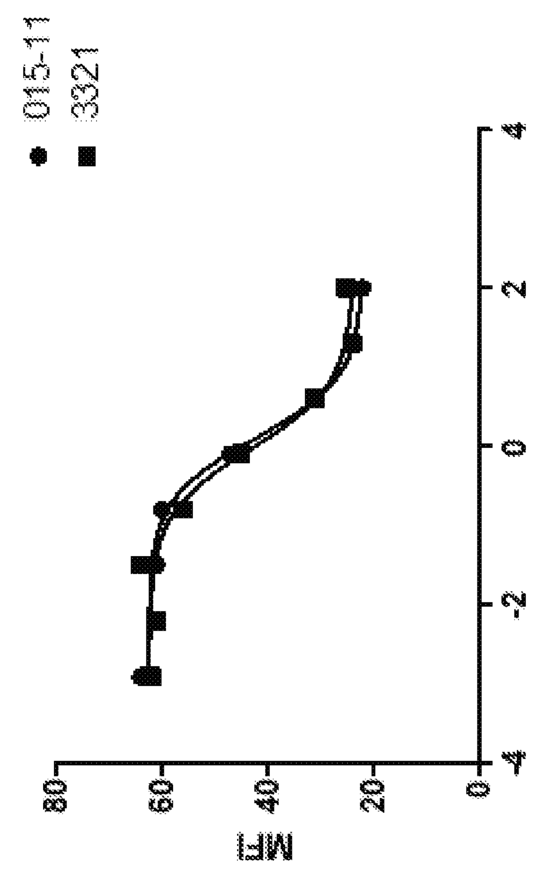
FIG. 3 depicts competitive binding analysis of the CD47-binding multi-specific molecules 1511 and 3321 using flow cytometry on the Jurkat cell line.

Competitive Flow Cytometry Binding Analysis of the Multi-Specific Molecules with Anti-CD47 Domain The competitive flow cytometry binding assay was performed to confirm the multi-specific molecules 1511 and 3321 block CD47 antigen binding to its receptor SIRPα on the cell surface natively expressing CD47. $1\times10^6$ cells/ml of Jurkat cells (ATCCR) in ice cold FACS Buffer (PBS, 1% BSA, 0.1% $NaN_3$) were incubated with 1511 or 3321 in a concentration range from 100 nM to 0.00128 nM and incubated for 45 min on ice, and then 25 nM SIRPα-Fc (R&D systems) was added and incubated for additional 45 min. The cells were washed with FACS Buffer and added goat anti-human VHH FITC conjugate antibody (Jackson Immuno Research) according to manufacturer's instructions, and then incubated for 30 min at 4° C. Data were acquired using GUAVAR EASYCYTE™ HT flow cytometer. Multi-specific molecules 1511 and 3321 competitively blocked CD47 binding to its receptor SIRPα on the Jurkat cell surface at EC50 depicted in FIG. 3.

Figure 4A:
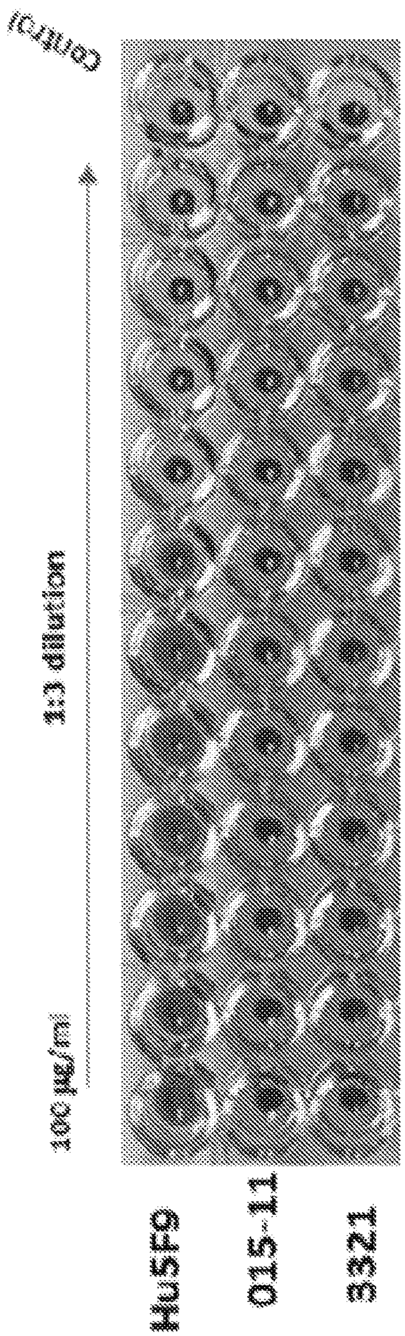
FIG. 4A depicts human red blood cell (RBC) hemagglutination assay using the CD47-binding multi-specific molecules 1511 and 3321. Hu5F9 was used as a control.
Figure 4B:
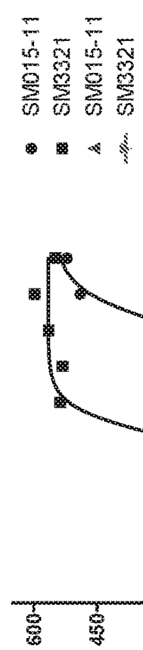
FIG. 4B depicts binding of 1511 and 3321 to HL-60 cells and human RBC.

Human RBC Hemagglutination Assay of the Multi-Specific Molecules with Anti-CD47 Domain Human blood samples were provided by healthy donors. The whole blood was centrifuged at 3000 rpm (1800rcf) for 5 min and the plasma and buffy coat were removed. The red cells were resuspended in normal saline (0.9% NaCl) with approximately 2 times the volume of the red cells, and the tube inverted to mix. The red blood cells were further centrifuged at 2000 rpm for 20 min and the RBCs were mixed with normal saline to obtain 6% (v/V) cell suspension. The RBC cells were then added to 96 well round bottom plate and mixed with different amounts of antibodies (0 to 100 μg/ml). The plates were incubated at 37 for 2 hours. Unlike the Hu5F9 anti-CD47 control antibody, multi-specific molecules 1511 and 3321 did not induce RBC agglutination depicted in FIG. 4.

Flow cytometry binding assay was performed to confirm the multi-specific molecules, 1511- and 3321-containing anti-CD47 VHH which could selectively bind to the tumor cell surface natively expressing CD47, but not RBC cell surface CD47. $1\times10^6$ cells/ml of HL60 cells (ATCC) or 10% washed human RBC cells (Rockland Immunochemicals, Inc) in ice cold FACS Buffer (PBS, 1% BSA, 0.1% $NaN_3$) were incubated with 1511 or 3321 in a concentration range from 500 nM to 0.00128 nM and incubated for 45 min on ice, The cells were washed with FACS buffer and added goat anti-human VHH FITC conjugate antibody (Jackson Immuno Research) according to manufacturer's instructions, and then incubated for 30 min at 4° C. Data were acquired using GUAVA® EASYCYTE™ HT flow cytometer. The multi-specific molecules 1511 and 3321 selectively bound to the tumor cell surface natively expressing CD47, but not RBC cell surface CD47 at EC50 depicted in FIG. 4B.

Anti-Tumor Activity of Multi-Specific Molecule Having Anti-CD47 Domain

Figure 5:
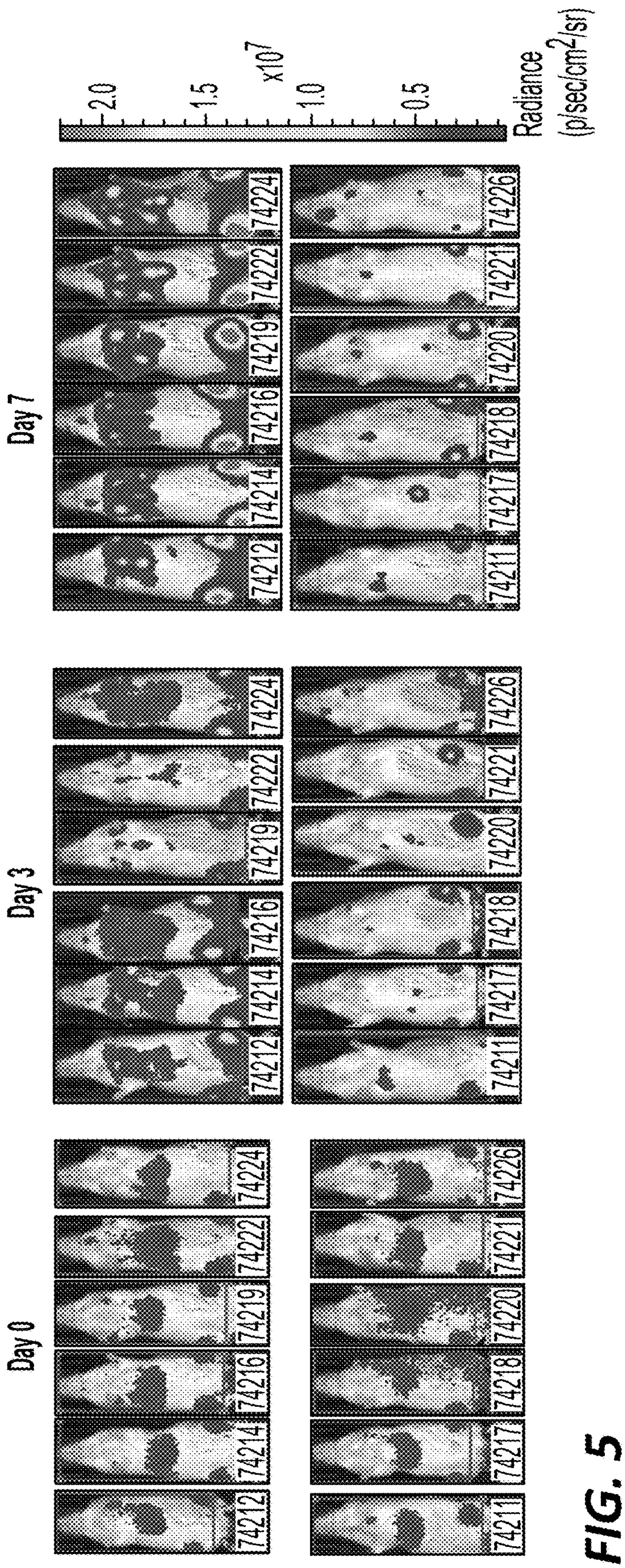
FIG. 5 depicts anti-tumor activity of the CD47-binding multi-specific molecule 3321 in Raja-Luc xenografted mice.

1E6 Raji-Luc cells were inoculated intravenously into NSG mice. The mice were daily treated with IV injections of the multi-specific molecule 3321 at 10 mg/kg or PBS control. Representative bioluminescence images of Raji tumors on start of treatment (Day 0), middle of experiment day 3 and termination of experiment (Day 7). The multi-specific molecule 3321 protected xenografted mice from human leukemia depicted in FIG. 5.

Example 2. Anti-PD-L1 HCAb Antibodies

Isolation of Anti-PD-L1 HCAb Antibodies from Immunized Llamas

Two llamas were immunized at Abcore Inc. following their standard protocols. Recombinant human PD-L1 (extracellular domain 19-238; SED ID NO: 30) were mixed with Complete Freund's Adjuvant (day 0) or Incomplete Freund's Adjuvant (following immunizations). Six subcutaneous injections per llama was performed at 50 μg/dose at biweekly intervals. At day 45, serum was collected from llamas immunized with recombinant PD-L1 protein to determine antibody titers against PD-L1 by ELISA. In ELISA, 96-well MAXISORP™ plates were coated with 100 ng/well PD-L1. After blocking and adding diluted sera samples, the presence of anti-PD-L1 antibodies was demonstrated using HRP-conjugated goat anti-llama IgG (H+L) antibody.

SEQ ID NO:30 Extracellular domain of human PD-L1 (19-238, Q9NZQ7)

FTVTVPKDLYVVEYGSNMTIECKFPVEKQLDLAA-LIVYWEMEDKNI IQFVH-GEEDLKVQHSSYRQRAR LLKDQLSLG-NAALQITDVKLQDAGVYRCMISYGGADYK-RITVKVNAPYNKINQRILVVDPVTSEHELT CQA-EGYP-KAEVIWTSSDHQVLSGKTTTTNSKREEKLFNVT-STLRINTTTNEIFYCTFRRLDPEENHTA ELVIPELPLAHPPNER

Peripheral blood mononuclear cells were prepared from day 45 blood samples from llamas immunized with recombinant PD-L1 protein using FICOLL-PAQUE® Plus density gradient media according to the manufacturer's instructions. Total RNA was extracted from the peripheral blood mononuclear cells using RNEASY® Midi Kit following manufacturer instructions and used as starting material for RT-PCR to amplify VHH-encoding gene fragments. These fragments were cloned into a phagemid vector, allowing production of recombinant phage particles, after infection with helper phage, which display the VHH as gene-Ill fusion proteins on the surface of the phage particles. Phage was prepared according to standard methods and stored after filter sterilization at 4° C. for further use.

For selection of PD-L1-binding VHH, biotinylated PD-L1 was incubated with the phage libraries and subsequently captured on streptavidin DYNABEADS®. Following extensive washing, bound phages were eluted with 1 mg/ml trypsin. The output from the selections was rescued in *E. coli* TG1 cells. Colonies were picked and sequenced at BATJ, Inc.

cDNAs encoding the PD-L1-binding VHH were synthesized with C-terminal His-tag and transiently transfected in HEK293 cells, and positive VHH were purified by IMAC chromatography.

PD-L1-binding phage colonies from immunized llama phage libraries were sequenced. Amino acid sequences were listed below (Table 4) for each VHH. cDNA sequences based on amino acid sequences below were fused with human Fc and synthesized in a pJ607 expression vector. The expression plasmids was transfected into a HEK293 cell line to produce recombinant anti-PD-L1 HCAb antibodies. The expressed anti-PD-L1 HCAbs were purified by HITRAP® protein A column. Two of the llama VHH, PL14 and PL16, were humanized based on IGHV3-23 human germline sequences.

TABLE 4

| Llama anti-PD-L1 VHH Sequences | |
|---|---|
| PL2 (SEQ ID NO: 31) | QVQLVESGGGLVQAGGSLRLSCAVSGLTLSRYTMAWFRQAPGKEREFVAAIIRNSVS TFHEESVKGRFTISRDNVKNMMYLQMNTLKPEDTAVYYCATNVGPTGGFSLQSVQRY DAWGQGTQVTVSS |
| PL11 (SEQ ID NO: 32) | QVQLVESGGGLVQAGGSLRLSCAASGRTFNTYDMGWFRRAPGKEREFVAGIDWYTTN TYYADSVKGRFTISRDNAKNTVYLQMRSLKPEDTAVYYCAAGIRSTATITGQADYWG QGAQVTVSS |
| PL14 (SEQ ID NO: 33) | EVQLVESGGGLVQAGGSLRLSCAASGSTSGIYDMGWYRQAPGKLREVVGIITSGGTT NYADFAKGRFTISRDNAKNMMYLQMNSLKPEDTAVYYCNIRTRLIIWGQGTQVTVSS |
| PL16 (SEQ ID NO: 34) | QVQLVESGGGLVQAGGSLRLSCAFSGGTFLTYSLGWFRQGPGKEREFVASINWSGYM TSYVDSVKGRFTISRDNAKNTVYLQMNSLKPEDTALYYCAAARTAIAAKRSSEFDYW GQGAQVTVSS |
| PL17 (SEQ ID NO: 35) | QVQLVESGGGLVQAGGSLRLSCAASGRTFNTYDMGWFRRTPGKEREFVAGMDWNTIN TYYADSVKGRFTISRDNAKNTVYLQMRSLKPEDTAVYYCAAGIRSTAIITGQADYWG QGTQVTVSS |
| PL18 (SEQ ID NO: 36) | EVQLVESGGGLVQAGGSLRLSCAASGRTFNIYSMAWFRQAPGKEREFVVRINWNRGT TYYADSVKGRFTISRDNAKNTVYLQMSNLKPEDTAVYYCAARGSPSTIGAFTSASHY DYWGQGTQVTVSS |
| hPL14 (SEQ ID NO: 37) | EVQLVESGGGLVQPGGSLRLSCAASGSTSGIYDMGWYRQAPGKLREVVSVITSGGTT YYADSVKGRFTISRDNSKNTLYLQMNSLRAEDTAVYYCNIRTRLIIWGQGTLVTVSS |
| hPL16 (SEQ ID NO: 38) | EVQLVESGGGLVQPGGSLRLSCAASGGTFLTYSMSWVRQAPGKEREFVSSINWSGYM TYYADSVKGRFTISRDNSKNTLYLQMNSLRAEDTAVYYCAAARTAIAAKRSSEFDYW GQGTQVTVSS |

The VHH of Table 4 constitute means for binding PD-L1.

OCTET® Kinetic Binding Analysis

OCTET® kinetic binding analysis was conducted as in Example 1. Briefly, purified anti-PD-L1 VHH was tested for its binding capacity with HIS1K sensor tips. Tips were loaded using 20 μg/ml of anti-PD-L1 VHH. Loading proceeded for 300 sec resulting in capture levels of between 1.8 and 2 nm. Human PD-L1 antigen were prepared for binding analysis by dilution to concentrations of 100, 150, 250, 350 nM in 1×PBS. Association was initiated and monitored for 200 sec, after which tips were transferred to 1×PBS buffer without PD-L1 protein, in order to monitor dissociation.

OCTET® kinetic analysis of binding affinity of anti-CD47 HCAb is presented in Table 5. The analysis demonstrated that PL14, PL16 and PL17 exhibit pM binding affinity.

TABLE 5

Binding Kinetic Analysis of Anti-PD-L1 HCAb (KD)

| VHH | $K_{on}$ (1/Ms) | $K_{off}$ (1/s) | $K_D$ (M) |
|---|---|---|---|
| PL2 | 3.33E+04 | 2.10E−02 | 6.30E−07 |
| PL11 | 2.75E+04 | 5.22E−04 | 1.90E−08 |
| PL14 | 6.21E+04 | 1.10E−06 | 1.77E−011 |
| PL16 | 1.10+05 | 2.98E−06 | 2.71E−011 |
| PL17 | 8.70E+04 | 1.09E−06 | 1.14E−011 |
| PL18 | 4.27E+04 | 1.14E−04 | 2.67E−09 |

Figure 6:
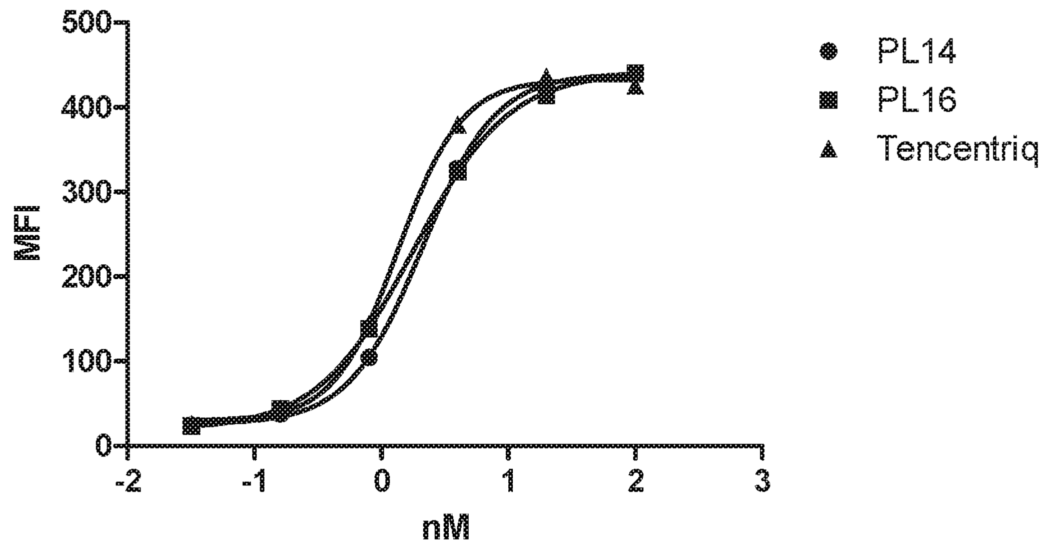
FIG. 6 depicts flow cytometry binding analysis of anti-PD-L1 HCAb, PL14 and PL16, on PD-L1 overexpressing CHO cells. Atezolizumab was used as a control.

Flow Cytometry Binding Analysis of Anti-PD-L1 HCAbs $1\times10^6$ cells/ml of PD-L1-overexpressing CHO cells in ice cold FACS buffer (PBS, 1% BSA, 0.1% $NaN_3$) were incubated with anti-PD-L1 HCAbs in a concentration range from 100 nM to 0.00128 nM and incubated for 45 min on ice. The cells were washed with FACS buffer and goat anti-human IgG Fc-FITC conjugate antibody (ThermoFisher) was added, and then incubated for 30 min at 4° C. Data were acquired using GUAVA® EASYCYTE™ HT flow cytometer. Binding affinity of anti-PD-L1 HCAbs for PD-L1 on PD-L1-overexpressing CHO cells was determined as $EC_{50}$ depicted in FIG. 6.

Cell-Based Functional Assay of Multi-Specific Molecule Having a PD-L1 Binding Domain PD-L1-expressing APC/CHO-K1 cells were seeded at 100K per well in a 96-well plate and incubated at 37° C. for 16 hr. Next, the multi-specific molecule 1511 and control antibody atezolizumab was serial diluted 1:3, starting at 100 nM, was added into cell wells at 25 μl/well. Finally, PD-1 effector cells (PD-1 and luciferase expressing cells) were added and incubated at 37° C. for 6 hr. After 6 hr, 75 μl of BIO-GLO™ Luciferase Assay Reagent were added and luminescence was measured using VICTOR Multilabel plate reader. Data analysis was performed with GRAPHPAD PRISM® software.

Figure 7:
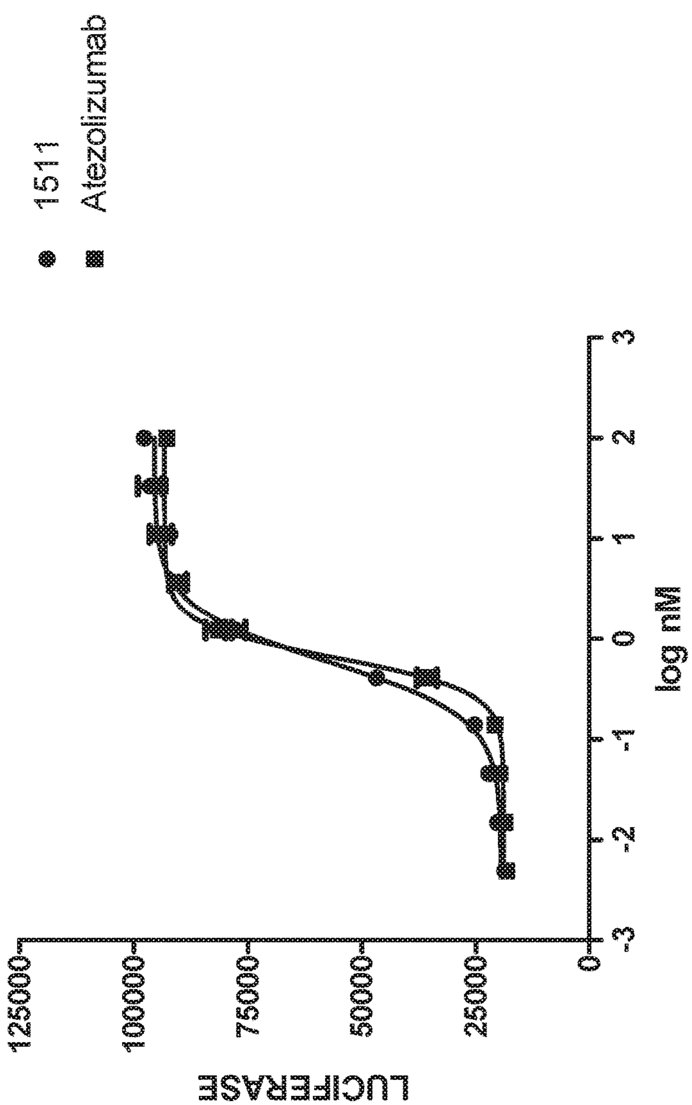
FIG. 7. Cell-based functional assay of the multi-specific molecule 1511 with binding specificity for PD-L1 and atezolizumab as a control.

The cell-based functional data indicated that the multi-specific molecule 1511 and control antibody atezolizumab completely blocked the PD-L1 activity with similar EC50 depicted in FIG. 7.

Anti-Tumor Activity of a Multi-Specific Molecule with a PD-L1 Binding Domain

Figure 8A:
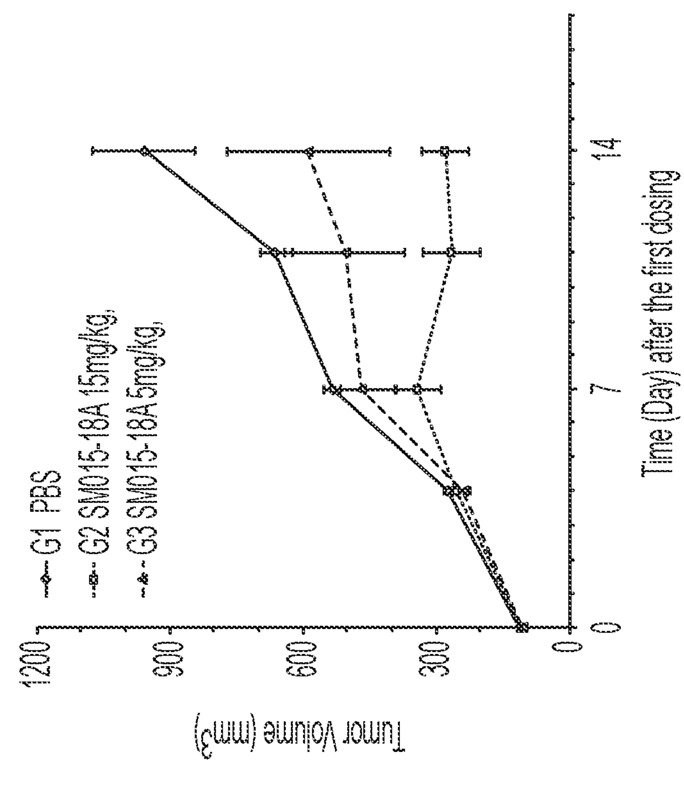
FIG. 8 depicts inhibition of MC38-hPD-L1 tumor growth in B-hPD-L1 mice by the PD-L1-binding multi-specific molecule 1518 (SEQ ID NO:1.57).
Figure 8B:
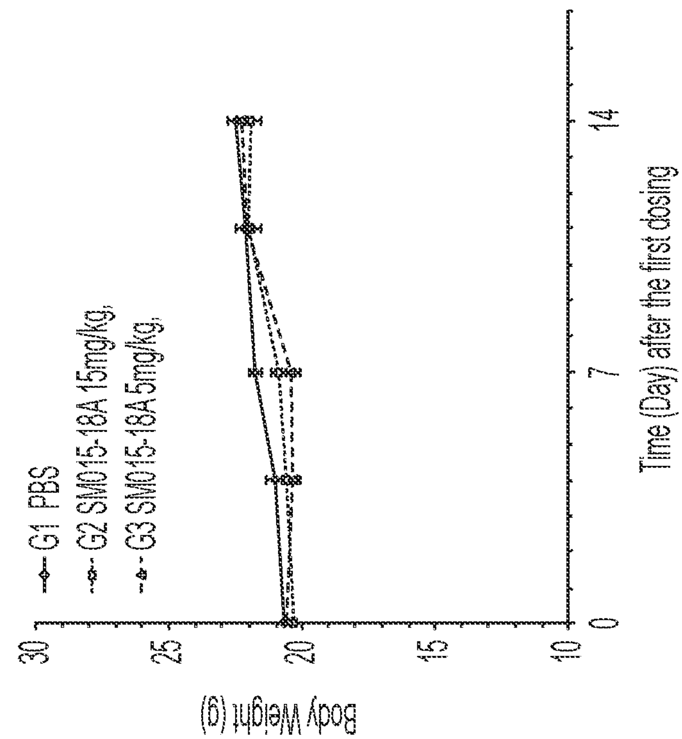

Murine colon cancer MC38-hPD-L1 cells (Biocytogen Co., Ltd; $5\times10^5$) were subcutaneously implanted into homozygous B-hPD-L1 mice (female, 6-week-old, n=6). Mice were grouped when tumor volume reached approximately 100 $mm^3$, at which time they were treated with the multi-specific molecule 1518 (SEQ ID NO: 157; CD16F-L1-HSA-L1-CD47-L3-CD47-L1-PDL1-L3-PDL1) with doses and schedules indicated in FIG. 8A. Body weight changes during treatment are shown in FIG. 8B. As shown in FIG. 8A, the multi-specific molecule 1518A1 was efficacious in controlling tumor growth in B-hPD-L1 mice. Values are expressed as mean±SEM.

Example 3. Anti-HSA HCAb Antibodies

Isolation of Anti-HSA VHH Antibodies

Llamas were immunized at Abcore, Inc. with recombinant human HSA (SEQ ID NO: 39) mixed with Complete Freund's Adjuvant (day 0) or Incomplete Freund's Adjuvant (following immunizations) as in Example 1.

```
Human serum albumin
                                    (SEQ ID NO: 39)
MKWVTFISLLFLFSSAYSRGVFRRDAHKSEVAHRFKDLGEENFKALVLI

AFAQYLQQCPFEDHVKLVNEVTEFAKTCVADESAENCDKSLHTLFGDKL

CTVATLRETYGEMADCCAKQEPERNECFLQHKDDNPNLPRLVRPEVDVM

CTAFHDNEETFLKKYLYEIARRHPYFYAPELLFFAKRYKAAFTECCQAA
```

-continued

```
DKAACLLPKLDELRDEGKASSAKQRLKCASLQKFGERAFKAWAVARLSQ

RFPKAEFAEVSKLVTDLTKVHTECCHGDLLECADDRADLAKYICENQDS

ISSKLKECCEKPLLEKSHCIAEVENDEMPADLPSLAADFVESKDVCKNY

AEAKDVFLGMFLYEYARRHPDYSVVLLLRLAKTYETTLEKCCAAADPHE

CYAKVFDEFKPLVEEPQNLIKQNCELFEQLGEYKFQNALLVRYTKKVPQ

VSTPTLVEVSRNLGKVGSKCCKHPEAKRMPCAEDYLSVVLNQLCVLHEK

TPVSDRVTKCCTESLVNRRPCFSALEVDETYVPKEFNAETFTFHADICT

LSEKERQIKKQTALVELVKHKPKATKEQLKAVMDDFAAFVEKCCKADDK

ETCFAEEGKKLVAASQAALGL
```

For selection of anti-HSA VHH, biotinylated HSA was incubated with the phage libraries and subsequently captured on streptavidin DYNABEADS® (Invitrogen). Following extensive washing, bound phages were eluted with 1 mg/ml trypsin. The output from the selections was rescued in *E. coli* TG1 cells. Colonies were picked and sequenced at BATJ, Inc. (San Diego, California).

cDNAs encoding the HSA-specific VHH were synthesized with C-terminal His-tag and transiently transfected in HEK293 cells, and positive VHH were purified by IMAC chromatography.

HSA-binding phage colonies from llama phage libraries were sequenced and the amino acid sequences were listed below (Table 6) for each VHH. cDNA sequences based on amino acid sequences below were synthesized in a pJ607 expression vector. The expression plasmids was transfected into a HEK293 cell line to produce recombinant single domain antibodies (sdAb) with C-terminal his-tag. The expressed sdAb were purified by HISTRAP® HP column.

Twp of the llama VHH, HS5 and HS10, was humanized based on IGHV3-23 human germline sequences.

TABLE 6

| Llama anti-HSA VHH Sequences | |
|---|---|
| HS2 (SEQ ID NO: 40) | EVQLVESGGGLVQAGGSLRLSCAASGRAFSSYAMGWFRQAPRKEREFVATISLSG GYTYYADSVKGRFTISRDNAKNTLYLQMNSLKPEDTAVYYCAAGESSSRQDKWYD YWGQGTQVTVSS |
| HS5 (SEQ ID NO: 41) | EVQLVESGGGLVQAGGSLRLSCAASGRTFTTHAMGWFRQAPGKEREFVATINWGG RTTYYADSVKGRFIISRDTGANTVYLQMNSLKPEDTAVYYCASNLDTYNVRAGTT NSWGQGTQVTVSS |
| HS6 (SEQ ID NO: 42) | EVQLVESGGGLVQAGGSLRLSCAASGRIFHTYAVGWFRQAPGKERESVVIINWSS DHTYVAQSVKGRFTISRDRAKNTFYLQMNSLKPEDTAVYYCAVRRRLYGLRESDF DSWGQGTQVTVSS |
| HS12 (SEQ ID NO: 43) | QVQLVESGGGSVQAGGSLRLSCAASGRTFISFSMGWFRQAPGKEREFVASITNSG SGILYGDSVKGRFTISRDNAKNTMYLQMNSLKPEDTAVYYCAAGTGAGRYRYASM FDYWGQGTQVTVSS |
| HS22 (SEQ ID NO: 44) | EVQLVESGGGLVHAGGSLRLSCAASGPTFSNYFMGWFRQAPGKEREFVAAVKWSG YHTYYSDSVKGQFTISRDNAKNTVYLQMNSLKPEDTAVYYCAAGGTFSNWYTRPR SGDSYDHWGQGTQVTVSS |
| HS27 (SEQ ID NO: 45) | EVQLVESGGGLVQPGGSLRLSCAASGRTFSPYTMGWFRQASGKERESVAATTWTG SRSYYGESVKGRFTISRDSTKNTMSLQMNSLKPEDTAVYYCAAADGAGLYTNRGQ YDYWGQGTQVTVSS |
| hHS5 (SEQ ID NO: 46) | EVQLLESGGGLVQPGGSLRLSCAASGRTFTTHAMGWFRQAPGKEREFVSAINWGG RTTYYADSVKGRFIISRDTGANTLYLQMNSLRAEDTAVYYCASNLDTYNVRAGTT NSWGQGTQVTVSS |

TABLE 6-continued

| Llama anti-HSA VHH Sequences | |
|---|---|
| HS10 (SEQ ID NO: 47) | EVQLVESGGGLVQPGGSERLSCAASGSTDSAYRMGWFRQAPGKEREFVSAINWSD GRTYYADSVKGRFTISRDNSKNTLYLQMNSLRAEDTAVYYCAADPDSRLYYTVPQ NYDYWGQGTLVTVSS |
| hHS10 (SEQ ID NO: 48) | EVQLVESGGGLVQPGGSLRLSCAASGSTDSAYRMGWFRQAPGKEREFVSAINWSD GRTYYADSVKGRFTISRDNSKNTLYLQMNSLRAEDTAVYYCAADPDSRLYYTVPQ NYDYWGQGTLVTVSS |

Thes VHH constitute means for binding HSA.

OCTET® Kinetic Binding Analysis

Figure 9:
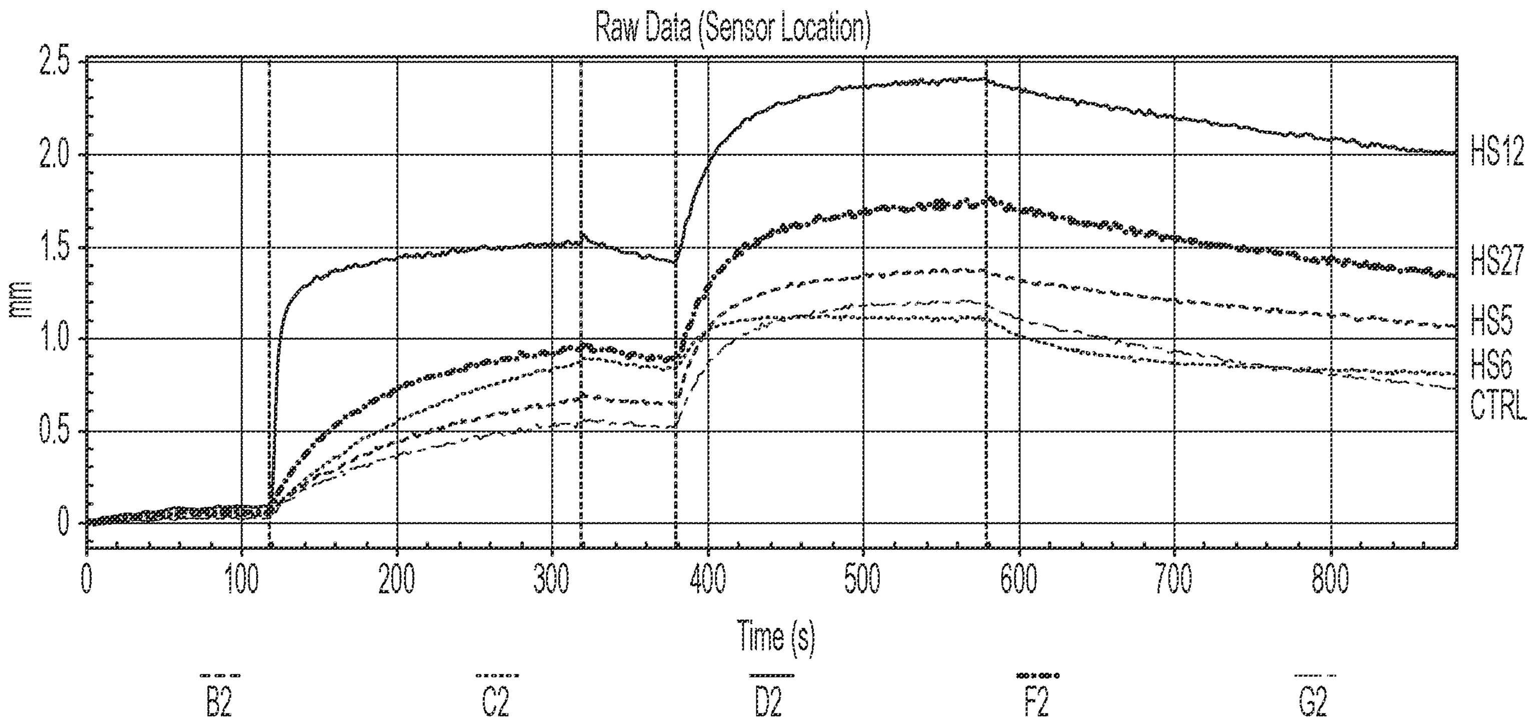
FIG. 9 depicts OCTET® binding analysis of anti-HSA VHH antibodies.

OCTET® kinetic binding analysis was conducted as in Example 1 and the results are presented in Table 7 and FIG. 9. The HS5, HS6, HS12, and HS27 clones demonstrate affinity for HSA. Cross-species activity was confirmed and listed in Table 8.

TABLE 7

Binding affinity ($K_D$) of anti-HSA VHH antibodies

| sdAb | $K_{on}$ (1/Ms) | $K_{off}$ (1/s) | $K_D$ (M) |
|---|---|---|---|
| HS2 | 1.72E+04 | 2.60E−02 | 1.51E−07 |
| HS5 | 8.09E+05 | 7.65E−04 | 9.46E−10 |
| HS6 | 1.67E+06 | 8.29E−04 | 4.980E−10 |
| HS12 | 1.03E+06 | 5.83E−04 | 5.68E−10 |
| HS22 | 1.73E+04 | 9.09E−05 | 5.25E−08 |
| HS27 | 7.61E+05 | 8.65E−04 | 4.32E−08 |
| HS5-41 | 4.22E+04 | 9.17E−05 | 1.14E−09 |
| HS10 | 2.77E+04 | 8.01E−05 | 2.89E−09 |

TABLE 8

Cross-species binding affinity of HS10 and HS5 VHH

| Samples | human ($K_D$) | Monkey ($K_D$) | mouse ($K_D$) |
|---|---|---|---|
| hHS10 | 3.18E−09 | 8.08E−09 | 4.57E−09 |
| hHS5 | 8.17E−10 | 1.16E−08 | NA |

Example 4. Anti-CD33 HCAb Antibodies

Isolation of Anti-CD33 VHH Antibodies

Llamas were immunized at Abcore, Inc. with recombinant human CD33 (SEQ ID NO: 49) mixed with Complete Freund's Adjuvant (day 0) or Incomplete Freund's Adjuvant (following immunizations) and phage libraries prepared as in Example 1.

```
Human CD33
                              (SEQ ID NO: 49, P20138|18-259)
DPNFWLQVQESVTVQEGLCVLVPCTFFHPIPYYDKNSPVHGYWFREGAI

ISRDSPVATNKLDQEVQEETQGRFRLLGDPSRNNCSLSIVDARRRDNGS

YFFRMERGSTKYSYKSPQLSVHVTDLTHRPKILIPGTLEPGHSKNLTCS

VSWACEQGTPPIFSWLSAAPTSLGPRTTHSSVLIITPRPQDHGTNLTCQ

VKFAGAGVTTERTIQLNVTYVPQNPTTGIFPGDGSGKQETRAGVVH
```

For selection of anti-CD33 VHH, biotinylated CD33 was incubated with the phage libraries and subsequently captured on streptavidin DYNABEADS®. Following extensive washing, bound phages were eluted with 1 mg/ml trypsin. The output from the selections was rescued in *E. coli* TG1 cells. Colonies were picked and sequenced at BATJ, Inc.

cDNAs encoding the CD33-binding VHH were synthesized with C-terminal His-tag at and transiently transfected in HEK293 cells, and positive VHH were purified by IMAC chromatography.

CD33-binding phage colonies from immunized llama phage libraries were sequenced and amino acid sequences were listed below (Table 9) for each VHH. cDNA sequences based on amino acid sequences below were fused with human Fc and synthesized in pJ607 expression vector. The expression plasmids was transfected into a HEK293 cell line to produce recombinant anti-CD33 HCAb antibodies. The expressed anti-CD33 HCAbs were purified by HITRAP® protein A column.

One of the llama VHH, 33-14, was humanized based on IGHV3-23 human germline sequences.

TABLE 9

| Llama anti-CD33 VHH Sequences | |
|---|---|
| 33-1 (SEQ ID NO: 50) | QVQLVESGGGLVQTGGSLRLSCAASGGTFTNYAMGWFREAPGKEREFVAGINNNG DTLYNTNSVKGRFTISRDNAKNTVYLHMNSLKLEDTAVYYCAANLKGASWYSANY DYWGQGTQVTVSS |
| 33-2 (SEQ ID NO: 51) | QVQLVESGGGLVQAGGSLRLSCTASANILRTAPMAWYRQAPGKQREFVALITADG TTDYQESVKGRFTTSRDNAKNTVYLQMNSLQSEDTARYFCKVYSYWGQGTQVTVS S |
| 33-4 (SEQ ID NO: 52) | QVQLVESGGGSVQPGGSLRLSCEASGSIFSIAHMGWYRQAPGKQRELVAVISSGG RTNYVDSVKGRFTISRDNAKNTVYLQMNSLKAEDTAVYFCNVAVVGGPRFDYWGQ GTQVTVSS |
| 33-8 (SEQ ID NO: 53) | EVQLMESGGGLVQAGGSLRLSCAASGRTVSTYVMGWFRQAPGKEREFVAEINRIG DTLYNRTSVKGRFTISRDNAKNTVYLQMNSLEPEDTAVYSCAARVIGTSTYNYWG QGTQVTVSS |
| 33-13 (SEQ ID NO: 54) | QVQLVESGGGLVQAGGSLRLSCAASGSISSINSMNWYRQAPGKQREKVAGINSSG DTNYVDSVKGRFTISRDNAERTTYLQMNNLKPEDTGLYYCNADPRPWPNDVAFGS WGQGTRVTVSS |

TABLE 9-continued

| Llama anti-CD33 VHH Sequences | |
|---|---|
| 33-14 (SEQ ID NO: 55) | QVQLVESGGGLVQAGDSLKLSCAASGRTSLILAMAWWRQAPGKEREFAGRIWWNNDMTRYSDSVKGRFTISKDNTKNMVYLRMDNLGPEDTAVYYCEADLIGGSRGWGQGTQVTVSS |
| 33-24 (SEQ ID NO: 56) | EVQLVESGGGLVQAGGSLRLSCLASGRTSSNSAMGWFRQAPGKEREFVGAITWNGDTTLYAYYVKDRFTISRDNAKRMVYLQMNSLKPEDTAVYYCAATDKFASSQADSYTTWGQGTQVTVSS |
| 33-A1 (SEQ ID NO: 57) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKFSGASWYSAQYHSWGQGTQVTVSS |
| 33-A2 (SEQ ID NO: 58) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANFNGASWFAANYHFWGQGTQVTVSS |
| 33-B1 (SEQ ID NO: 59) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKLKGASWFASHYKSWGQGTQVTVSS |
| 33-B2 (SEQ ID NO: 60) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANINAASWFAAKYDSWGQGTQVTVSS |
| 33-B3 (SEQ ID NO: 61) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVRGSSWFSSHYDFWGQGTQVTVSS |
| 33-C1 (SEQ ID NO: 62) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANLSGASWFASQYEFWGQGTQVTVSS |
| 33-C2 (SEQ ID NO: 63) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVKGASWFSANYQSWGQGTQVTVSS |
| 33-C3 (SEQ ID NO: 64) | QVQLVESGGGLVQTGGSLRLSCVASGGTFTNYAMGWFREAPGKEREFVAGINNNGDTLYNTNSVKGRFTISRDNAKNTVYLHMNSLKLEDTAVYYCAANFKGASWFASHYQSWGQGTQVTVSS |
| 33-D1 (SEQ ID NO: 65) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANFNGASWFSSNYEYWGQGTQVTVSS |
| 33-D2 (SEQ ID NO: 66) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANIRGSSWFATHYDSWGQGTQVTVSS |
| 33-D3 (SEQ ID NO: 67) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANLRGASWFAANYKYWGQGTQVTVSS |
| 33-E2 (SEQ ID NO: 68) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKLRGASWFAANYDSWGQGTQVTVSS |
| 33-E3 (SEQ ID NO: 69) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANISAASWYASQYDFWGQGTQVTVSS |
| 33-F1 (SEQ ID NO: 70) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVSGASWYASHYEFWGQGTQVTVSS |
| 33-F2 (SEQ ID NO: 71) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVSEASWFASKYDFWGQGTQVTVSS |
| 33-F3 (SEQ ID NO: 72) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKISGASWFAAHYKSWGQGTQVTVSS |
| 33-G1 (SEQ ID NO: 73) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKFRGASWFSSHYNFWGQGTQVTVSS |

TABLE 9-continued

| Llama anti-CD33 VHH Sequences | |
|---|---|
| 33-G2 (SEQ ID NO: 74) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVKGASWFSSNYKYWGQGTQVTVSS |
| 33-G3 (SEQ ID NO: 75) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANIKASSWYSSHYNYWGQGTQVTVSS |
| 33-H1 (SEQ ID NO: 76) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVRGASWFAAHYNSWGQGTQVTVSS |
| 33-H2 (SEQ ID NO: 77) | QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKVRAASWFAAQYKFWGQGTQVTVSS |
| h33-14 (SEQ ID NO: 78) | QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS |

The VHH of Table 9 constitute means for binding CD33.

Figure 10A:
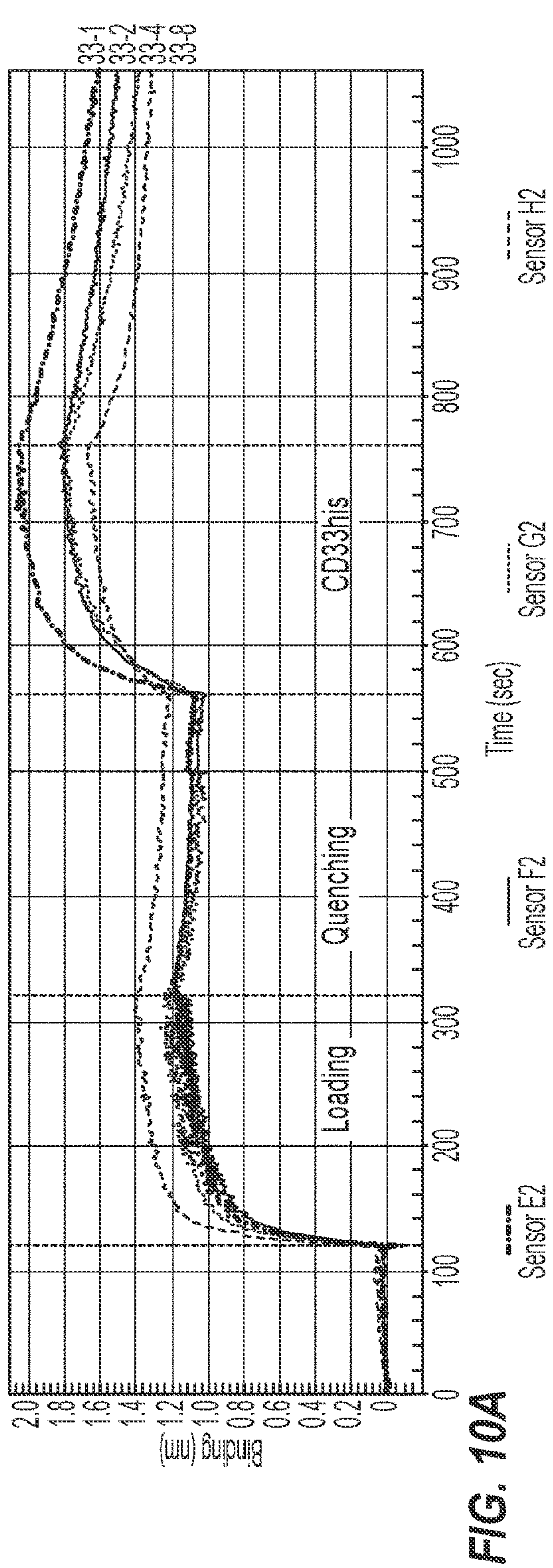
FIG. 10A-B depicts OCTET® binding affinity analysis of anti-CD33 VHH antibodies.
Figure 10B:
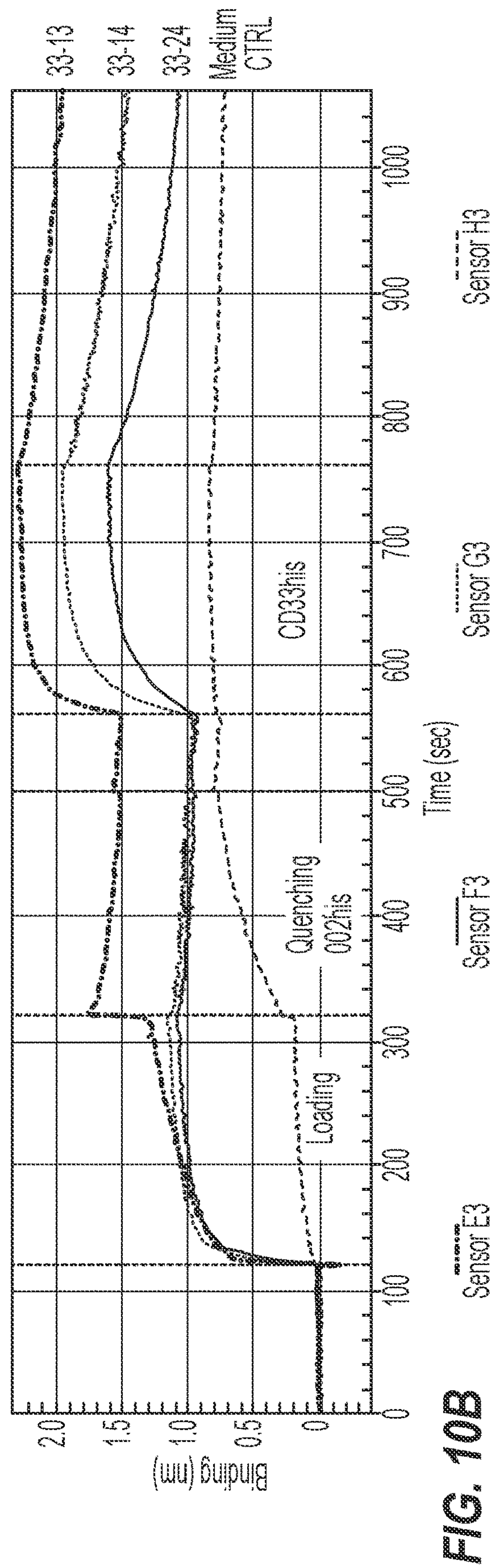

OCTET® kinetic binding analysis was conducted as in Example 1 and the $K_D$ results are presented in FIG. 10 and Table 10.

TABLE 10

Binding affinity of anti-CD33 VHH antibodies

| VHH | $K_{on}$ (1/Ms) | $K_{off}$ (1/s) | $K_D$ (M) |
|---|---|---|---|
| 33-1 | 8.0+05 | 8.10E−04 | 1.01E−09 |
| 33-2 | 8.0E+05 | 6.0E−04 | 7.53E−10 |
| 33-4 | 9.0E+05 | 9.0E−04 | 9.95E−10 |
| 33-8 | 1.1E+06 | 7.0E−04 | 5.11E−10 |
| 33-13 | 1.0E+06 | 5E−04 | 4.09E−10 |
| 33-14 | 8.0E+05 | 1.09E−04 | 1.36E−010 |
| 33-24 | 8.0E+05 | 9E−04 | 1.13E−010 |

Example 5. Anti-LAG3 VHH

Isolation of Anti-LAG3 VHH Antibodies

Llamas were immunized at Abcore, Inc. following their standard protocols. Recombinant human LAG3 (extracellular domain 19-238, SEQ ID NO:79) were mixed with Complete Freund's Adjuvant (day 0) or Incomplete Freund's Adjuvant (following immunizations). Six subcutaneous injections per llama was performed at 50 μg/dose at biweekly intervals. At day 45, serum was collected from llamas immunized with recombinant human LAG3 protein to define antibody titers against human LAG3 by ELISA. In ELISA, 96-well MAXISORP™ plates were coated with 100 ng/well LAG3. After blocking and adding diluted sera samples, the presence of anti-LAG3 antibodies was demonstrated using Antibody titers of anti-sera were determined by ELISA. 96-well MAXISORP™ plates were coated with 100 ng/well hLAG3. After blocking and adding diluted sera samples, the presence of anti-LAG3 antibodies was demonstrated using HRP-conjugated goat anti-llama IgG (H+L) antibody.

```
Extracellular domain of human LAG3
                              (SEQ ID NO: 79, P18627, 23-450)
VPVVWAQEGAPAQLPCSPTIPLQDLSLLRRAGVTWQHQPDSGPPAAAPG
HPLAPGPHPAAPSSWGPRPRRYTVLSVGPGGLRSGRLPLQPRVQLDERG
RQRGDFSLWLRPARRADAGEYRAAVHLRDRALSCRLRLRLGQASMTASP
PGSLRASDWVILNCSFSRPDRPASVHWFRNRGQGRVPVRESPHHHLAES
FLFLPQVSPMDSGPWGCILTYRDGFNVSIMYNLTVLGLEPPTPLTVYAG
AGSRVGLPCRLPAGVGTRSFLTAKWTPPGGGPDLLVTGDNGDFTLRLED
VSQAQAGTYTCHIHLQEQQLNATVTLAIITVTPKSFGSPGSLGKLLCEV
TPVSGQERFVWSSLDTPSQRSFSGPWLEAQEAQLLSQPWQCQLYQGERL
LGAAVYFTELSSPGAQRSGRAPGALPAGHL
```

Phage libraries were prepared as in Examples 1-4. cDNAs encoded the LAG3-binding VHH were synthesized with C-terminal His-tag and transiently transfected in HEK293 cells, and LAG3-binding VHH were purified by IMAC chromatography.

LAG3-binding phage colonies from immunized llama phage libraries were sequenced and amino acid sequences were listed below (Table 11) for each VHH. cDNA sequences based on amino acid sequences below were fused with human Fc and synthesized in pJ607 expression vector. The expression plasmids was transfected into a HEK293 cell line to produce recombinant anti-LAG3 HCAb antibodies. The expressed anti-LAG3 HCAbs were purified by HITRAP® protein A column.

One of the llama VHH, LG9, was humanized based on IGHV3-23 human germline sequences.

TABLE 11

| Llama anti-LAG3 VHH Sequences | |
|---|---|
| LG2 (SEQ ID NO: 80) | QVQLVESGGGLVQPGGSLRLSCAASGTIFSINAMGWYRQAPGKQRELVAIVTFGGSTNYADSVKGRFTISRDNAKNTVYLQMNSLKPEDTAVYYCSARNVQSPVQYHLAVWGQGTLVTVSS |

TABLE 11-continued

| Llama anti-LAG3 VHH Sequences | |
|---|---|
| LG6 (SEQ ID NO: 81) | EVQLVESGGGLVQAGGSLRLSCAVSGSIFSISTMGWYRQAPGKQRELVASITARGSADYADSVKGRFTISRDNAKNTVYLQMSSLKPEDTAVYYCNTDTRSTLYHYSWGQGTQVTVSS |
| LG9 (SEQ ID NO: 82) | EVQLVESGGGLVQPGGSLRLSCAASGSTIDDYPIGWFRQAPGKEREGVSCIDDSDESTYYADSVKGRFTISRDNAKNTVYLQMNSLKPEDTAVYYCARGAIFMIDGVDVFLTYYYDSWGQGTQVTVSS |
| hLG9 (SEQ ID NO: 83) | EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSS |
| LG19 (SEQ ID NO: 84) | QVQLVESGGGLVQPGGSLRLSCAASGFTLDYYAIGWFRQAPGKEREGVSCISSSDGSTYYADSVKGRFTISRDNAKNTVYLQMNSLKPEDTAVYYCAADRRGSCRQYDYWGQGTQVTVSS |
| LG22 (SEQ ID NO: 85) | EVQLVESGGGLVQPGGSLRLSCAASGFTLDYYAIGWFRQAPGKEREGVSCIINSDGSTYYADSVKGRFTISRDNAKNTVYLQMNSLKPEDTAVYYCATDRYSDCRGPYDYWGQGTQVTVSS |
| LG-D8 (SEQ ID NO: 86) | QVQLVESGGGLVQPGGSLRLSCAASGFTFGKYAMSWVRQVPDKGLEWVSSISSSGRDTSYADSAKGRFTIFRNNAANTVYLQMDNLKLEDTGVYYCVKCLEVWATREYDGWGQGTQVTVSS |
| LG-E12 (SEQ ID NO: 87) | QVQLVESGGGLVHPGGSLNLSCVAHGFSLDSHDMGWFRQAPGKEREVVACIKHRDGRIYILEAVKDRFVISRDNAKNTVYLEMNNLSDEDTAVYHCATASSCSDNWWLLIGDAYAGYWGQGTQVTVSS |
| LG15 (SEQ ID NO: 88) | EVQLAESGGGLVQPGGSLRLSCATSGFAFRSYVMSWVRQAPGKGLEWVSTINSDSRTSYADSVKGRFTISRDNAKNTLYLQMNSLKVEDTAVYYCSKQSPGTSQRGQGTQVTVSS |
| LG65 (SEQ ID NO: 89) | QVQLVESGGGLVQPGGSLRLSCAVSGFTSATYSIAWFRQAPGKEREGVSCISTGDGSTYYAPAVKGRFTISSDNAKNTVYLQMNGLKPEDTAVYYCAKRAGYGSAWFCPLDPSLQYDSWGQGTQVTVSS |
| LG99 (SEQ ID NO: 90) | EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGALFMIDGVDVFLTYYFEFWGQGTLVTVSS |
| LG-C4 (SEQ ID NO: 91) | QVQLVESGGRLVQAGGSLGLSCAASGLAFREYSMGWFRRAPGKEREFVAAVDWTGIQYYADSVKGRATISRDTAKSTVFLQMNSLNPEDTAFYYCAAGKKLTGIVLLTRRTEYDYWGQGTQVTVSS |
| LG-E5 (SEQ ID NO: 92) | QVQLVESGGGLVQPGGSLRLSCAHSGFTLDYYALGWFRQAPGKEREAVSCISSSDGSTYYADSVKGRFTISRDNAKNTVYLQMNSLKPEDTAVYYCASTRYGSSCRGGQWDTGSWGQGTQVTVSS |
| LG-H4 (SEQ ID NO: 93) | QVQLVESGGGLVQPGGSLRLSCAASGFSLDYYTIGWFRQAPGKEREAVSCINRSDGSTYYADSVKGRFTISRDNAKNTVYLQMNSLKPEDTAVYYCASTTYGTSCRGGQWDTGSWGQGTQVTVSS |

The VHH of Table 11 constitute means for binding LAG3.

OCTET® binding analysis of anti-LAG3 VHH was conducted as in Examples 1~4 and the results expressed in Table 12.

TABLE 12

| Binding affinity ($K_D$) of anti-LAG3 single domain antibodies | | | |
|---|---|---|---|
| sdAb | $K_{on}$ (1/Ms) | $K_{off}$ (1/s) | $K_D$ (M) |
| LG2 | 3.33E+04 | 2.10E−02 | 6.30E−07 |
| LG6 | 2.75E+04 | 5.22E−04 | 1.90E−08 |
| LG9 | 6.21E+04 | 1.10E−04 | 1.77E−09 |
| LG9H | 1.10+05 | 2.98E−04 | 2.71E−09 |
| LG19 | 8.70E+04 | 1.09E−05 | 1.14E−010 |
| LG22 | 4.27E+04 | 1.14E−05 | 2.67E−010 |
| LG-D8 | 3.30E+04 | 9.82E−05 | 2.98E−09 |
| LG-99 | 3.67E+05 | 2.91E−05 | 7.92E−11 |

Example 6. Anti-CD16 VHH

Isolation of Anti-CD16 VHH Antibodies

Llamas were immunized at Abcore Inc following their standard protocols. Recombinant human CD16A (SEQ ID NO:94) were mixed with Complete Freund's Adjuvant (day 0) or Incomplete Freund's Adjuvant (following immunizations). Six subcutaneous injections per llama was performed at 50 μg/dose at biweekly intervals. At day 45, serum was collected from immunized llamas to define antibody titers by ELISA. In ELISA, 96-well MAXISORP™ plates were coated with 100 ng/well antigen. After blocking and adding diluted sera samples, the presence of specific antibodies was demonstrated using HRP-conjugated goat anti-llama IgG (H+L) antibody.

```
Human CD16A
                                         (SEQ ID NO: 94)
MWQLLLPTALLLLVSAGMRTEDLPKAVVFLEPQWYRVLEKDSVTLKCQG

AYSPEDNSTQWFHNESLISSQASSYFIDAATVDDSGEYRCQTNLSTLSD

PVQLEVHIGWLLLQAPRWVFKEEDPIHLRCHSWKNTALHKVTYLQNGKG

RKYFHHNSDFYIPKATLKDSGSYFCRGLFGSKNVSSETVNITITQGLAV

STISSFFPPGYQVSFCLVMVLLFAVDTGLYFSVKTNIRSSTRDWKDHKF

KWRKDPQDK
```

```
Human CD16B
                                         (SEQ ID NO: 95)
MWQLLLPTALLLLVSAGMRTEDLPKAVVFLEPQWYSVLEKDSVTLKCQG

AYSPEDNSTQWFHNESLISSQASSYFIDAATVNDSGEYRCQTNLSTLSD

PVQLEVHIGWLLLQAPRWVFKEEDPIHLRCHSWKNTALHKVTYLQNGKD

RKYFHHNSDFHIPKATLKDSGSYFCRGLVGSKNVSSETVNITITQGLAV

STISSFSPPGYQVSFCLVMVLLFAVDTGLYFSVKTNI
```

Phage libraries were prepared as in Example 1. cDNAs encoded the CD16A-binding VHH were synthesized with C-terminal His-tag, and transiently transfected in HEK293 cells, and CD16A-binding VHH were purified by IMAC chromatography.

CD16A-binding phage colonies from immunized llama phage libraries were sequenced and amino acid sequences were listed below (Table 13) for each VHH. cDNA sequences based on amino acid sequences below were fused with human Fc and synthesized in pJ607 expression vector. The expression plasmids was transfected into a HEK293 cell line to produce recombinant anti-CD16 HCAb antibodies. The expressed anti-CD16 HCAbs were purified by HITRAP® protein A column.

One of the llama VHH, CD16F1, was humanized based on IGHV3-23 human germline sequences.

TABLE 13

| Anti-CD16 VHH sequences | |
|---|---|
| CD16F1 (SEQ ID NO: 96) | EVQLVESGGGLVQPGGSLRLSCAVSGSLFSARVMGWYRQAPGKQRELVAAITSGVRT DYADSVKGRFTISRDNAKRAVYLQMNSLKPEDTAVYYCNVNLYNTGNYWGQGTQVTV SS |
| hCD16F1-1 (SEQ ID NO: 97) | EVQLVESGGGLVQPGGSLRLSCAVSGSLFSARVMSWVRQAPGKQRELVSAITSGVRT YYADSVKGRFTISRDNAKRAVYLQMNSLKPEDTAVYYCNVNLYNTGNYWGQGTQVTV SS |
| hCD16F1-2 (SEQ ID NO: 98) | EVQLVESGGGLVQPGGSLRLSCAVSGSLFSARVMSWVRQAPGKQRELVSAITSGVRT YYADSVKGRFTISRDNAKRAVYLQMNSLRAEDTAVYYCNVNLYNTGNYWGQGTQVTV SS |
| CD16E11 (SEQ ID NO: 99) | QVQLVESGGGLVQPGGSLTLSCRASGFTFSNHAMSWVRQAPGKGLEWVSEISFNGHA TRYADSLKGRFTISRDNAKNTLYLQMNTLKPEDTAVYYCRKGWNATPQIGERGRGTQ VTVSS |

The VHH of Table 13 constitute means for binding CD16.

Figure 11A:
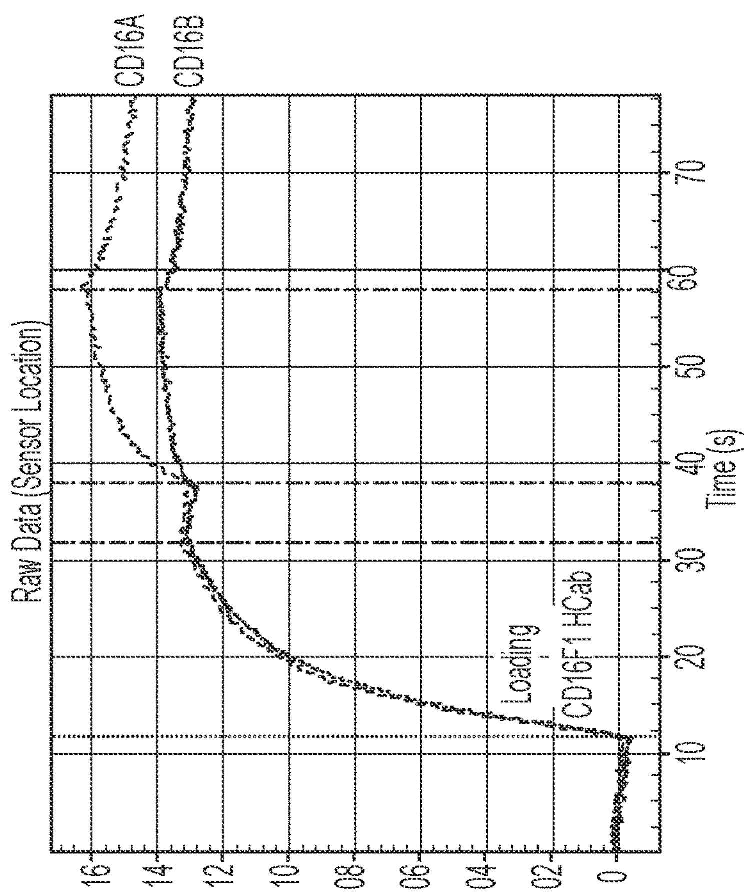
FIG. 11A-B depicts OCTET® binding analysis of ant-CD16A VHH molecules CD16F1 (FIG. 11A) and CD16E11 (FIG. 11B).
Figure 11B:
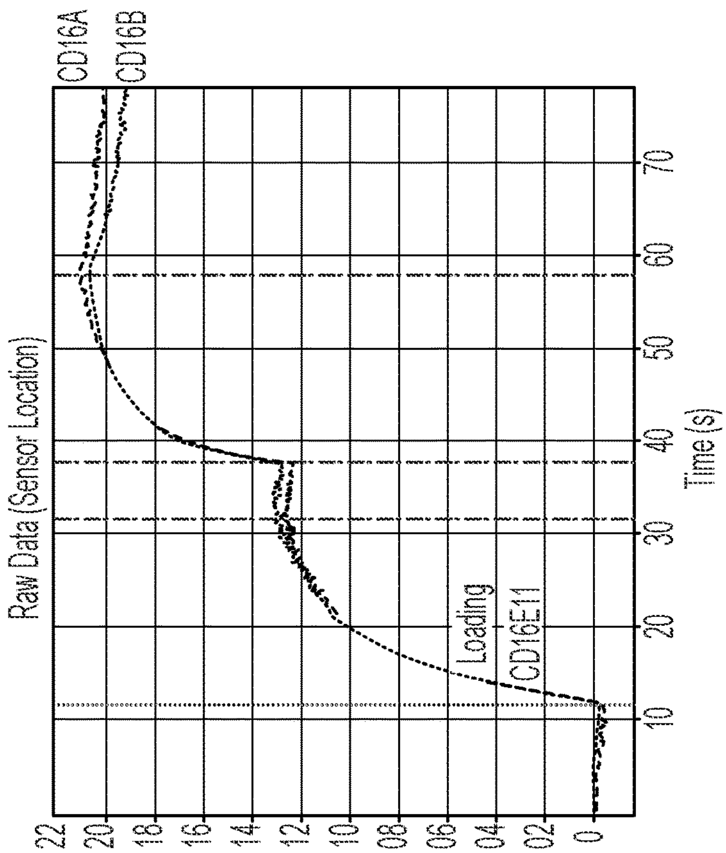

OCTET® binding analysis of anti-CD16 VHH was conducted as in Example 1 and the results expressed in Table 14 and FIG. 11.

TABLE 14

| Binding affinity (KD) of anti-CD16 VHH antibodies | | | |
|---|---|---|---|
| sdAb | $K_{on}$ (1/Ms) | $K_{off}$ (1/s) | $K_D$ (M) |
| CD16F1 | 2.33E+04 | 1.09E−04 | 4.68E−09 |
| CD16E11 | 1.99E+04 | 6.00E−05 | 3.02E−09 |

CD16-F1 is selective for CD16A while CD16-E11 binds to both CD16A and CD16B.

Both CD16F1 and CD16E11 are agonist anti-CD16 VHH antibody which activated CD16A in Jurkat-Lucia NFAT-CD16 ADCC reporter assay (Invivogen).

Figure 12:
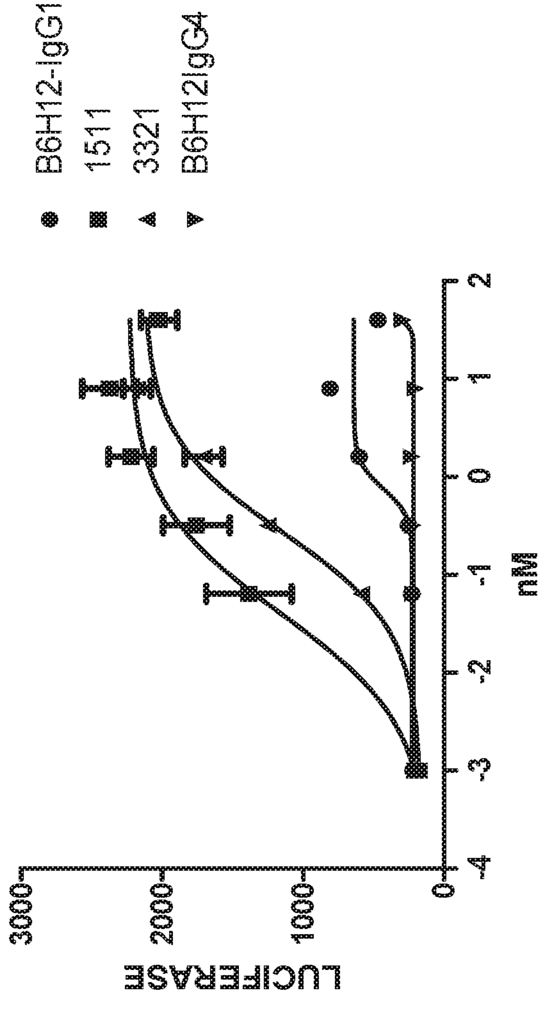
FIG. 12 depicts a cell-based functional assay of the multi-specific molecules 1511 and 3321 in Jurkat NFAT CD16 reporter assay (ADCC assay) using IgG1 B6H12 and IgG4 B6H12 as controls.

A functional assay of the multi-specific molecules 1511, 3321 (containing anti-CD16A VHH CD16F1), and control anti-CD47 antibodies, B6H12 IgG1 and B6H12 IgG4 using Jurkat-Lucia NFAT-CD16 reporter assay (Invivogen) and results expressed in FIG. 12. The data indicated CD16F1 is a potent CD16A agonist.

Example 7. Tri-Specific Single Chain Antibody (HSA/CD47/PD-L1 or HSA/LAG3/PD-L1)

Figure 13A:
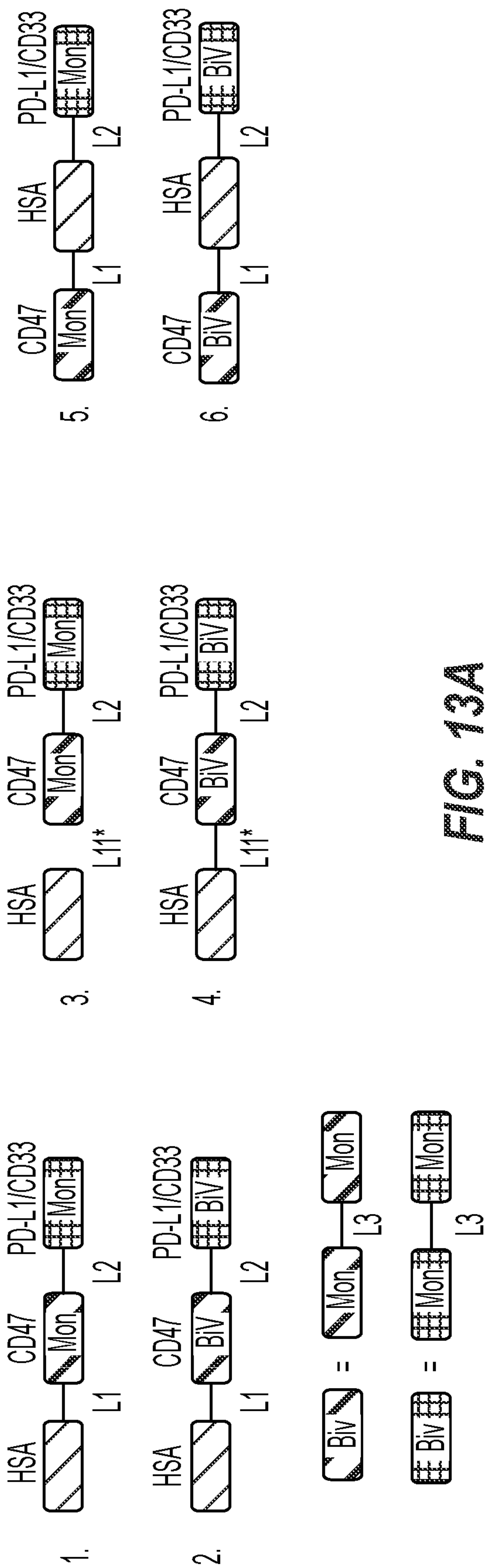
FIG. 13A-C depicts tri-specific molecule formats of molecules having HSA and CD47-binding domains (FIG. 13A), molecules having HSA- and LAG3-binding domains (FIG. 13B), and molecules having HSA- and CD16-binding domains (FIG. 13C).
Figure 13B:
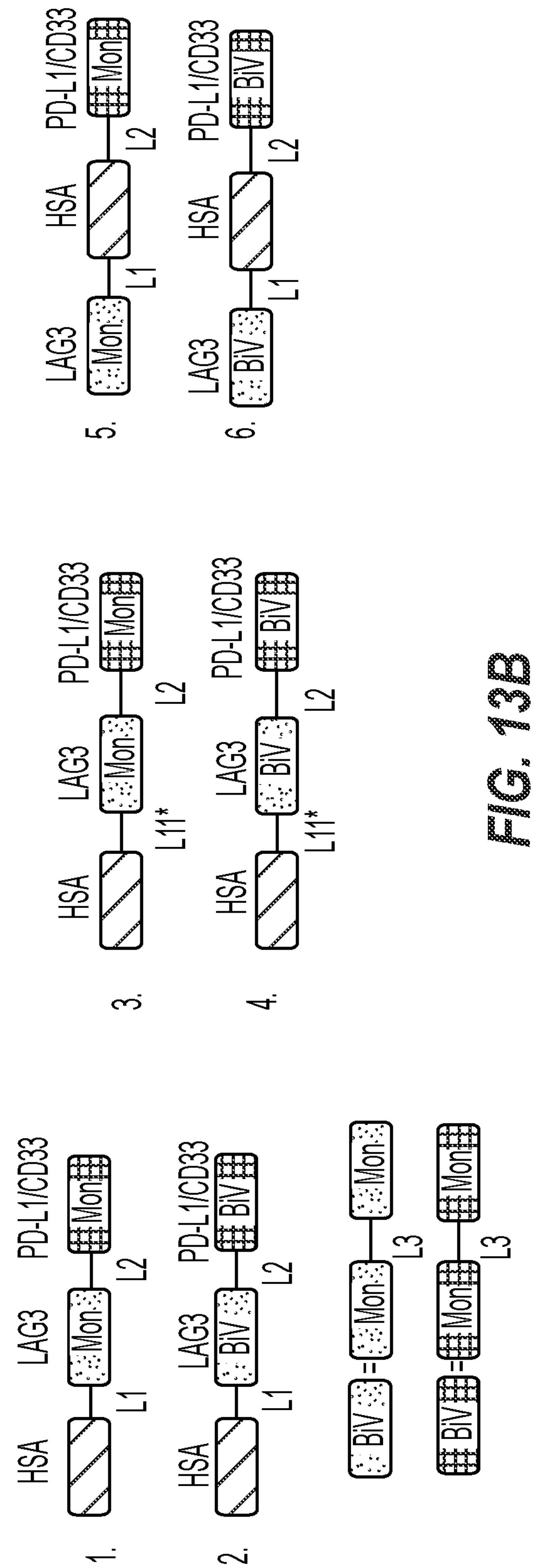
Figure 13C:
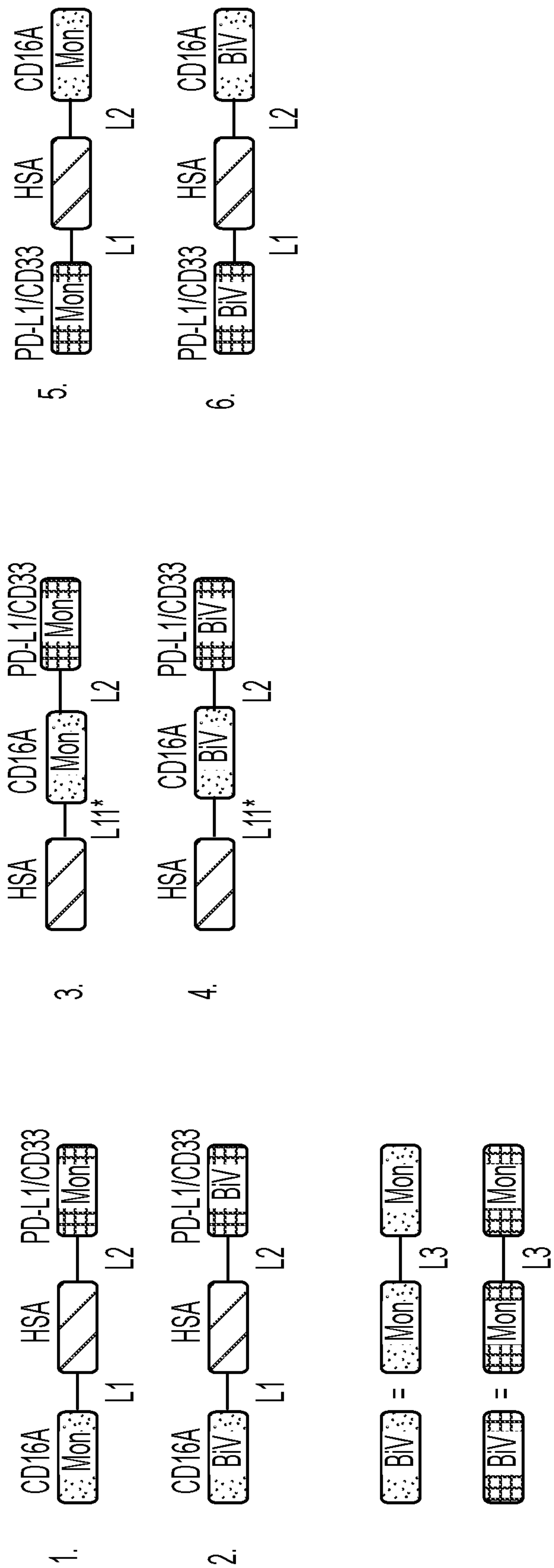

To construct a tri-specific single chain antibody, anti-HSA, anti-CD47, and anti-PD-L1 or anti-CD33 VHH sequences or anti-HSA, anti-LAG3, and anti-PD-L1 or CD33 VHH sequences were fused together via linkers in six different ways by recombinant DNA technology (FIG. 13). FIG. 13 depicts the structures of exemplary tri-specific molecules anti-HSA/CD47/PD-L1, anti-HSA/CD47/CD33 and anti-HSA/LAG3/PD-L1, anti-HSA/LAG37/CD33 antibodies. Exemplary non-cleavable and cleavable linker sequences are presented in Table 15. These constitute linker means or means for linking protein domains. These mean can be further characterized as cleavable or non-cleavable. The amino acid sequences of exemplary tri-specific molecules are presented in Table 16. Linker sequences in Tables 16 and 17 are underlined.

TABLE 15

Non-cleavable and cleavable linker sequences

| Linker Reference | Sequence | Cleavable? |
|---|---|---|
| L1 (SEQ ID NO: 100) | GGGGSGGGS | No |
| L2 (SEQ ID NO: 101) | $(G_4S)n(G_3S)m$ (n = 1-35; m = 0-35) | No |
| L3 (SEQ ID NO: 102) | AAA | No |
| L4 (SEQ ID NO: 103) | $(G_4S)n$ | No |
| L11*3 (SEQ ID NO: 104) | GGRGPLGLAGSRSAFGGS | Yes |
| L11*4 (SEQ ID NO: 105) | GSPLGLAGS | Yes |
| L11*5 (SEQ ID NO: 106) | GGSGPLGLAGSRSAFG | Yes |
| L11*6 (SEQ ID NO: 107) | GPLGLAGSRSAGGSQVQL | Yes |
| L11*7 (SEQ ID NO: 108) | GSGPLGLAARSAGGS | Yes |
| L11*8 (SEQ ID NO: 109) | GSGPLGLAARSAFGGS | Yes |
| L11*9 (SEQ ID NO: 110) | GGSGRSAPLGLARQARQVGGS | Yes |
| L11*10 (SEQ ID NO: 111) | GGSGRSAPLGLGRQARGGS | Yes |
| L11*11 (SEQ ID NO: 112) | GGSPLGLARQARGSGRSAGGS | Yes |
| L11*12 (SEQ ID NO: 113) | GGSGRSAPLGLARQARVVGGS | Yes |
| L11*13 (SEQ ID NO: 114) | GSRQARVVGS | Yes |
| L11*14 (SEQ ID NO: 115) | GSRQRRVVGS | Yes |
| L11*15 (SEQ ID NO: 116) | GSRQARGS | Yes |
| L11*16 (SEQ ID NO: 117) | GSRQRRGS | Yes |
| L11*17 (SEQ ID NO: 118) | GSRQARGGS | Yes |
| L11*18 (SEQ ID NO: 119) | GSRQRRGGS | Yes |

TABLE 16

| Tri-specific molecules | |
|---|---|
| hHS5-L11*3-<br>hA09-10-2-L1-<br>hPL16<br>(SEQ ID NO: 120) | EVQLLESGGGLVQPGGSLRLSCAASGRTFTTHAMGWFRQAPGKEREFVSAINWG<br>GRTTYYADSVKGRFIISRDTGANTLYLQMNSLRAEDTAVYYCASNLDTYNVRAG<br>TTNSWGQGTQVTVSSGGSPLGLAGRSAFGGSEVQLVESGGGLVQPGGSLRLSCA<br>ASGGGRTFSNYALGWFRQAPGKEREFVAAISRSGGNINYADSVKGRFTISRDNF<br>KNTTYLQMSSLEPEDTAVYYCAAHYLLLPSYISTSTNMYNYWGQGTQVTVSSGG<br>GGSGGGSEVQLVESGGGLVQPGGSLRLSCAASGGTFLTYSMSWVRQAPGKEREF<br>VSSINWSGYMTYYADSVKGRFTISRDNSKNTLYLQMNSLRAEDTAVYYCAAART<br>AIAAKRSSEFDYWGQGTQVTVSS |
| hHS5-L11*3-<br>hA09-10-2-L3-<br>A09-10-L1-hPL16<br>(SEQ ID NO: 121) | EVQLLESGGGLVQPGGSLRLSCAASGRTFTTHAMGWFRQAPGKEREFVSAINWG<br>GRTTYYADSVKGRFIISRDTGANTLYLQMNSLRAEDTAVYYCASNLDTYNVRAG<br>TTNSWGQGTQVTVSSGGSPLGLAGRSAFGGSEVQLVESGGGLVQPGGSLRLSCA<br>ASGGGRTFSNYALGWFRQAPGKEREFVAAISRSGGNINYADSVKGRFTISRDNF<br>KNTTYLQMSSLEPEDTAVYYCAAHYLLLPSYISTSTNMYNYWGQGTQVTVSSAA<br>AQVQLVESGGGLVQAGGSLRLSCAASGGGRTFSNYALGWFRQAPGKEREFVAAI |

TABLE 16-continued

| Tri-specific molecules | |
|---|---|
| | SRSGGNINYADSVKGRFTISRDNFKNTTYLQMSSLEPEDTAVYYCAAHYLLLPS YISTSTNMYNYWGQGTQVTVSSGGGGSGGGSEVQLVESGGGLVQPGGSLRLSCA ASGGTFLTYSMSWVRQAPGKEREFVSSINWSGYMTYYADSVKGRFTISRDNSKN TLYLQMNSLRAEDTAVYYCAAARTAIAAKRSSEFDYWGQGTQVTVSS |
| hHS5-L11*3-hA09-10-2-L3-A09-10-L1-hPL16-L3-hPL16 (SEQ ID NO: 122) | EVQLLESGGGLVQPGGSLRLSCAASGRTFTTHAMGWFRQAPGKEREFVSAINWG GRTTYYADSVKGRFIISRDTGANTLYLQMNSLRAEDTAVYYCASNLDTYNVRAG TTNSWGQGTQVTVSSGGSPLGLAGRSAFGGSEVQLVESGGGLVQPGGSLRLSCA ASGGGRTFSNYALGWFRQAPGKEREFVAAISRSGGNINYADSVKGRFTISRDNF KNTTYLQMSSLEPEDTAVYYCAAHYLLLPSYISTSTNMYNYWGQGTQVTVSSAA AQVQLVESGGGLVQAGGSLRLSCAASGGGRTFSNYALGWFRQAPGKEREFVAAI SRSGGNINYADSVKGRFTISRDNFKNTTYLQMSSLEPEDTAVYYCAAHYLLLPS YISTSTNMYNYWGQGTQVTVSSGGGGSGGGSEVQLVESGGGLVQPGGSLRLSCA ASGGTFLTYSMSWVRQAPGKEREFVSSINWSGYMTYYADSVKGRFTISRDNSKN TLYLQMNSLRAEDTAVYYCAAARTAIAAKRSSEFDYWGQGTQVTVSSAAAEVQL VESGGGLVQPGGSLRLSCAASGGTFLTYSMSWVRQAPGKEREFVSSINWSGYMT YYADSVKGRFTISRDNSKNTLYLQMNSLRAEDTAVYYCAAARTAIAAKRSSEFD YWGQGTQVTVSS |
| hA09-10-1-L1-hHS5-L1-hPL16 (SEQ ID NO: 123) | EVQLVESGGGLVQPGGSLRLSCAASGGGRTFSNYALGWFRQAPGKEREFVAAIS RSGGNINYADSVKGRFTISRDNAKNTVYLQMSSLRAEDTAVYYCAAHYLLLPSY ISTSTNMYNYWGQGTQVTVSSGGGGSGGGSEVQLLESGGGLVQPGGSLRLSCAA SGRTFTTHAMGWFRQAPGKEREFVSAINWGGRTTYYADSVKGRFIISRDTGANT LYLQMNSLRAEDTAVYYCASNLDTYNVRAGTTNSWGQGTQVTVSSGGGGSGGGS EVQLVESGGGLVQPGGSLRLSCAASGGTFLTYSMSWVRQAPGKEREFVSSINWS GYMTYYADSVKGRFTISRDNSKNTLYLQMNSLRAEDTAVYYCAAARTAIAAKRS SEFDYWGQGTQVTVSS |
| hA09-10-2-L3-A09-10-L1-hHS5-L1-hPL16 (SEQ ID NO: 124) | EVQLVESGGGLVQPGGSLRLSCAASGGGRTFSNYALGWFRQAPGKEREFVAAIS RSGGNINYADSVKGRFTISRDNFKNTTYLQMSSLEPEDTAVYYCAAHYLLLPSY ISTSTNMYNYWGQGTQVTVSSAAAQVQLVESGGGLVQAGGSLRLSCAASGGGRT FSNYALGWFRQAPGKEREFVAAISRSGGNINYADSVKGRFTISRDNFKNTTYLQ MSSLEPEDTAVYYCAAHYLLLPSYISTSTNMYNYWGQGTQVTVSSGGGGSGGGS EVQLLESGGGLVQPGGSLRLSCAASGRTFTTHAMGWFRQAPGKEREFVSAINWG GRTTYYADSVKGRFIISRDTGANTLYLQMNSLRAEDTAVYYCASNLDTYNVRAG TTNSWGQGTQVTVSSGGGGSGGGSEVQLVESGGGLVQPGGSLRLSCAASGGTFL TYSMSWVRQAPGKEREFVSSINWSGYMTYYADSVKGRFTISRDNSKNTLYLQMN SLRAEDTAVYYCAAARTAIAAKRSSEFDYWGQGTQVTVSS |
| hA09-10-2-L3-A09-10-L1-hHS5-L1-hPL16-L3-hPL16 (SEQ ID NO: 125) | EVQLVESGGGLVQPGGSLRLSCAASGGGRTFSNYALGWFRQAPGKEREFVAAIS RSGGNINYADSVKGRFTISRDNFKNTTYLQMSSLEPEDTAVYYCAAHYLLLPSY ISTSTNMYNYWGQGTQVTVSSAAAQVQLVESGGGLVQAGGSLRLSCAASGGGRT FSNYALGWFRQAPGKEREFVAAISRSGGNINYADSVKGRFTISRDNFKNTTYLQ MSSLEPEDTAVYYCAAHYLLLPSYISTSTNMYNYWGQGTQVTVSSGGGGSGGGS EVQLLESGGGLVQPGGSLRLSCAASGRTFTTHAMGWFRQAPGKEREFVSAINWG GRTTYYADSVKGRFIISRDTGANTLYLQMNSLRAEDTAVYYCASNLDTYNVRAG TTNSWGQGTQVTVSSGGGGSGGGSEVQLVESGGGLVQPGGSLRLSCAASGGTFL TYSMSWVRQAPGKEREFVSSINWSGYMTYYADSVKGRFTISRDNSKNTLYLQMN SLRAEDTAVYYCAAARTAIAAKRSSEFDYWGQGTQVTVSSAAAEVQLVESGGGL VQPGGSLRLSCAASGGTFLTYSMSWVRQAPGKEREFVSSINWSGYMTYYADSVK GRFTISRDNSKNTLYLQMNSLRAEDTAVYYCAAARTAIAAKRSSEFDYWGQGTQ VTVSS |
| hA09-10-3-L1-hHS5-L1-hPL16-L3-hPL16 (SEQ ID NO: 126) | EVQLVESGGGLVQPGGSLRLSCAASGGGRTFSNYALGWFRQAPGKEREFVAAIS RSGGNINYADSVKGRFTISRDNFKNTVYLQMSSLRAEDTAVYYCAAHYLLLPSY ISTSTNMYNYWGQGTQVTVSSGGGGSGGGSEVQLLESGGGLVQPGGSLRLSCAA SGRTFTTHAMGWFRQAPGKEREFVSAINWGGRTTYYADSVKGRFIISRDTGANT LYLQMNSLRAEDTAVYYCASNLDTYNVRAGTTNSWGQGTQVTVSSGGGGSGGGS EVQLVESGGGLVQPGGSLRLSCAASGGTFLTYSMSWVRQAPGKEREFVSSINWS GYMTYYADSVKGRFTISRDNSKNTLYLQMNSLRAEDTAVYYCAAARTAIAAKRS SEFDYWGQGTQVTVSSAAAEVQLVESGGGLVQPGGSLRLSCAASGGTFLTYSMS WVRQAPGKEREFVSSINWSGYMTYYADSVKGRFTISRDNSKNTLYLQMNSLRAE DTAVYYCAAARTAIAAKRSSEFDYWGQGTQVTVSS |
| hHS5-L11*3-hA09-10-3-L1-H33-14 (SEQ ID NO: 127) | EVQLLESGGGLVQPGGSLRLSCAASGRTFTTHAMGWFRQAPGKEREFVSAINWG GRTTYYADSVKGRFIISRDTGANTLYLQMNSLRAEDTAVYYCASNLDTYNVRAG TTNSWGQGTQVTVSSGGSPLGLAGRSAFGGSEVQLVESGGGLVQPGGSLRLSCA ASGGGRTFSNYALGWFRQAPGKEREFVAAISRSGGNINYADSVKGRFTISRDNF KNTVYLQMSSLRAEDTAVYYCAAHYLLLPSYISTSTNMYNYWGQGTQVTVSSGG GGSGGGSQVQLVESGGGLVQPGGSLRLSCAASGRTSLILAMAWWRQAPGKEREF AGRIWWNNDMTRYSDSVKGRFTISRDNAKNTVYLQMSSLRAEDTAVYYCEADLI GGSRGWGQGTQVTVSS |
| hHS5-L11*3-hA09-10-2-L3-A09-10-L1-H33-14 (SEQ ID NO: 128) | EVQLLESGGGLVQPGGSLRLSCAASGRTFTTHAMGWFRQAPGKEREFVSAINWG GRTTYYADSVKGRFIISRDTGANTLYLQMNSLRAEDTAVYYCASNLDTYNVRAG TTNSWGQGTQVTVSSGGSPLGLAGRSAFGGSEVQLVESGGGLVQPGGSLRLSCA ASGGGRTFSNYALGWFRQAPGKEREFVAAISRSGGNINYADSVKGRFTISRDNF KNTTYLQMSSLEPEDTAVYYCAAHYLLLPSYISTSTNMYNYWGQGTQVTVSSAA |

TABLE 16-continued

| Tri-specific molecules | |
|---|---|
| | AQVQLVESGGGLVQAGGSLRLSCAASGGGRTFSNYALGWFRQAPGKEREFVAAI<br>SRSGGNINYADSVKGRFTISRDNFKNTTYLQMSSLEPEDTAVYYCAAHYLLLPS<br>YISTSTNMYNYWGQGTQVTVSSGGGGSGGGSQVQLVESGGGLVQPGGSLRISCA<br>ASGRTSLILAMAWWRQAPGKEREFAGRIWWNNDMTRYSDSVKGRFTISRDNAKN<br>TVYLQMSSLRAEDTAVYYCEADLIGGSRGWGQGTQVTVSS |
| hHS5-L1-hA09-10-2-L3-A09-10-L1-H33-14-L3-H33-14 (SEQ ID NO: 129) | EVQLLESGGGLVQPGGSLRLSCAASGRTFTTHAMGWFRQAPGKEREFVSAINWG<br>GRTTYYADSVKGRFIISRDTGANTLYLQMNSLRAEDTAVYYCASNLDTYNVRAG<br>TTNSWGQGTQVTVSSGGGGSGGGSEVQLVESGGGLVQPGGSLRLSCAASGGGRT<br>FSNYALGWFRQAPGKEREFVAAISRSGGNINYADSVKGRFTISRDNFKNTTYLQ<br>MSSLEPEDTAVYYCAAHYLLLPSYISTSTNMYNYWGQGTQVTVSSAAAQVQLVE<br>SGGGLVQAGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYISTSTN<br>MYNYWGQGTQVTVSSGGGGSGGGSQVQLVESGGGLVQPGGSLRLSCAASGRTSL<br>ILAMAWWRQAPGKEREFAGRIWWNNDMTRYSDSVKGRFTISRDNAKNTVYLQMS<br>SLRAEDTAVYYCEADLIGGSRGWGQGTQVTVSSAAAQVQLVESGGGLVQPGGSL<br>RLSCAASGRTSLILAMAWWRQAPGKEREFAGRIWWNNDMTRYSDSVKGRFTISR<br>DNAKNTVYLQMSSLRAEDTAVYYCEADLIGGSRGWGQGTQVTVSS |
| hHS5-L11*3-hA09-10-2-L3-A09-10-L1-H33-14-L3-H3-14 (SEQ ID NO: 130) | EVQLLESGGGLVQPGGSLRLSCAASGRTFTTHAMGWFRQAPGKEREFVSAINWG<br>GRTTYYADSVKGRFIISRDTGANTLYLQMNSLRAEDTAVYYCASNLDTYNVRAG<br>TTNSWGQGTQVTVSSGGSPLGLAGRSAFGGSEVQLVESGGGLVQPGGSLRLSCA<br>ASGGGRTFSNYALGWFRQAPGKEREFVAAISRSGGNINYADSVKGRFTISRDNF<br>KNTTYLQMSSLEPEDTAVYYCAAHYLLLPSYISTSTNMYNYWGQGTQVTVSSAA<br>AQVQLVESGGGLVQAGGSLRLSCAASGGGRTFSNYALGWFRQAPGKEREFVAAI<br>SRSGGNINYADSVKGRFTISRDNFKNTTYLQMSSLEPEDTAVYYCAAHYLLLPS<br>YISTSTNMYNYWGQGTQVTVSSGGGGSGGGSQVQLVESGGGLVQPGGSLRLSCA<br>ASGRTSLILAMAWWRQAPGKEREFAGRIWWNNDMTRYSDSVKGRFTISRDNAKN<br>TVYLQMSSLRAEDTAVYYCEADLIGGSRGWGQGTQVTVSSAAAQVQLVESGGGL<br>VQPGGSLRLSCAASGRTSLILAMAWWRQAPGKEREFAGRIWWNNDMTRYSDSVK<br>GRFTISRDNAKNTVYLQMSSLRAEDTAVYYCEADLIGGSRGWGQGTQVTVSS |
| hA09-10-3-L1-hHS5-L1-H33-14 (SEQ ID NO: 131) | EVQLVESGGGLVQPGGSLRLSCAASGGGRTFSNYALGWFRQAPGKEREFVAAIS<br>RSGGNINYADSVKGRFTISRDNFKNTVYLQMSSLRAEDTAVYYCAAHYLLLPSY<br>ISTSTNMYNYWGQGTQVTVSSGGGGSGGGSEVQLLESGGGLVQPGGSLRLSCAA<br>SGRTFTTHAMGWFRQAPGKEREFVSAINWGGRTTYYADSVKGRFIISRDTGANT<br>LYLQMNSLRAEDTAVYYCASNLDTYNVRAGTTNSWGQGTQVTVSSGGGGSGGGS<br>QVQLVESGGGLVQPGGSLRLSCAASGRTSLILAMAWWRQAPGKEREFAGRIWWN<br>NDMTRYSDSVKGRFTISRDNAKNTVYLQMSSLRAEDTAVYYCEADLIGGSRGWG<br>QGTQVTVSS |
| hA09-10-2-L3-A09-10-L1-hHS5-L1-H33-14 (SEQ ID NO: 132) | EVQLVESGGGLVQPGGSLRLSCAASGGGRTFSNYALGWFRQAPGKEREFVAAIS<br>RSGGNINYADSVKGRFTISRDNFKNTTYLQMSSLEPEDTAVYYCAAHYLLLPSY<br>ISTSTNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTTYLQ<br>MSSLEPEDTAVYYCAAHYLLLPSYISTSTNMYNYWGQGTQVTVSSGGGGSGGGS<br>EVQLLESGGGLVQPGGSLRLSCAASGRTFTTHAMGWFRQAPGKEREFVSAINWG<br>GRTTYYADSVKGRFIISRDTGANTLYLQMNSLRAEDTAVYYCASNLDTYNVRAG<br>TTNSWGQGTQVTVSSGGGGSGGGSQVQLVESGGGLVQPGGSLRLSCAASGRTSL<br>ILAMAWWRQAPGKEREFAGRIWWNNDMTRYSDSVKGRFTISRDNAKNTVYLQMS<br>SLRAEDTAVYYCEADLIGGSRGWGQGTQVTVSS |
| hA09-10-L1-hHS5-11-H33-14-L3-H33-14 (SEQ ID NO: 133) | EVQLVESGGGLVQPGGSLRLSCAASGGGRTFSNYALGWFRQAPGKEREFVAAIS<br>RSGGNINYADSVKGRFTISRDNAKNTVYLQMSSLRAEDTAVYYCAAHYLLLPSY<br>ISTSTNMYNYWGQGTQVTVSSGGGGSGGGSEVQLLESGGGLVQPGGSLRLSCAA<br>SGRTFTTHAMGWFRQAPGKEREFVSAINWGGRTTYYADSVKGRFIISRDTGANT<br>LYLQMNSLRAEDTAVYYCASNLDTYNVRAGTTNSWGQGTQVTVSSGGGGSGGGS<br>QVQLVESGGGLVQPGGSLRLSCAASGRTSLILAMAWWRQAPGKEREFAGRIWWN<br>NDMTRYSDSVKGRFTISRDNAKNTVYLQMSSLRAEDTAVYYCEADLIGGSRGWG<br>QGTQVTVSSAAAQVQLVESGGGLVQPGGSLRLSCAASGRTSLILAMAWWRQAPG<br>KEREFAGRIWWNNDMTRYSDSVKGRFTISRDNAKNTVYLQMSSLRAEDTAVYYC<br>EADLIGGSRGWGQGTQVTVSS |
| hA09-10-2-L3-A09-10-L1-hHS5-L1-H33-14-L3-H33-14 (SEQ ID NO: 134) | EVQLVESGGGLVQPGGSLRLSCAASGGGRTFSNYALGWFRQAPGKEREFVAAIS<br>RSGGNINYADSVKGRFTISRDNFKNTTYLQMSSLEPEDTAVYYCAAHYLLLPSY<br>ISTSTNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTTYLQ<br>MSSLEPEDTAVYYCAAHYLLLPSYISTSTNMYNYWGQGTQVTVSSGGGGSGGGS<br>EVQLLESGGGLVQPGGSLRLSCAASGRTFTTHAMGWFRQAPGKEREFVSAINWG<br>GRTTYYADSVKGRFIISRDTGANTLYLQMNSLRAEDTAVYYCASNLDTYNVRAG<br>TTNSWGQGTQVTVSSGGGGSGGGSQVQLVESGGGLVQPGGSLRLSCAASGRTSL<br>ILAMAWWRQAPGKEREFAGRIWWNNDMTRYSDSVKGRFTISRDNAKNTVYLQMS<br>SLRAEDTAVYYCEADLIGGSRGWGQGTQVTVSSAAAQVQLVESGGGLVQPGGSL<br>RLSCAASGRTSLILAMAWWRQAPGKEREFAGRIWWNNDMTRYSDSVKGRFTISR<br>DNAKNTVYLQMSSLRAEDTAVYYCEADLIGGSRGWGQGTQVTVSS |

TABLE 16-continued

| Tri-specific molecules | |
|---|---|
| H33-14-L1-hHS5-<br>L1-CD16F1<br>(SEQ ID NO: 135) | QVQLVESGGGLVQPGGSLRLSCAASGRTSLILAMAWWRQAPGKEREFAGRIWWN<br>NDMTRYSDSVKGRFTISRDNAKNTVYLQMSSLRAEDTAVYYCEADLIGGSRGWG<br>QGTQVTVSSGGGGSGGGSEVQLLESGGGLVQPGGSLRLSCAASGRIFTTHAMGW<br>FRQAPGKEREFVSAINWGGRTTYYADSVKGRFIISRDTGANTLYLQMNSLRAED<br>TAVYYCASNLDTYNVRAGTTNSWGQGTLVTVSSGGGGSGGGSEVQLVESGGGLV<br>QPGGSLRLSCAVSGSLFSARVMGWYRQAPGKQRELVAAITSGVRTDYADSVKGR<br>FTISRDNAKRAVYLQMNSLKPEDTAVYYCNVNLYNTGNYWGQGTQVTVSS |
| H33-14-L1-hHS5-<br>L1-CD16F1-L3-<br>CD16F1<br>(SEQ ID NO: 136) | QVQLVESGGGLVQPGGSLRLSCAASGRTSLILAMAWWRQAPGKEREFAGRIWWN<br>NDMTRYSDSVKGRFTISRDNAKNTVYLQMSSLRAEDTAVYYCEADLIGGSRGWG<br>QGTQVTVSSGGGGSGGGSEVQLLESGGGLVQPGGSLRLSCAASGRTFTTHAMGW<br>FRQAPGKEREFVSAINWGGRITTYYADSVKGRFIISRDTGANTLYLQMNSLRAED<br>TAVYYCASNLDTYNVRAGTTNSWGQGTQVTVSSGGGGSGGGSEVQLVESGGGLV<br>QPGGSLRLSCAVSGSLFSARVMGWYRQAPGKQRELVAAITSGVRTDYADSVKGR<br>FTISRDNAKRAVYLQMNSLKPEDTAVYYCNVNLYNTGNYWGQGTQVTVSSAAAE<br>VQLVESGGGLVQPGGSLRLSCAVSGSLFSARVMGWYRQAPGKQRELVAAITSGV<br>RTDYADSVKGRFTISRDNAKRAVYLQMNSLKPEDTAVYYCNVNLYNTGNYWGQG<br>TQVTVSS |
| H33-14-L3-H33-<br>14-L1-hHS5-L1-<br>CD16F1<br>(SEQ ID NO: 137) | QVQLVESGGGLVQPGGSLRLSCAASGRTSLILAMAWWRQAPGKEREFAGRIWWN<br>NDMTRYSDSVKGRFTISRDNAKNTVYLQMSSLRAEDTAVYYCEADLIGGSRGWG<br>QGTQVTVSSAAAQVQLVESGGGLVQPGGSLRLSCAASGRTSLILAMAWWRQAPG<br>KEREFAGRIWWNNDMTRYSDSVKGRFTISRDNAKNTVYLQMSSLRAEDTAVYYC<br>EADLIGGSRGWGQGTQVTVSSGGGGSGGGSEVQLLESGGGLVQPGGSLRLSCAA<br>SGRTFTTHAMGWFRQAPGKEREFVSAINWGGRTTYYADSVKGRFIISRDTGANT<br>LYLQMNSLRAEDTAVYYCASNLDTYNVRAGTTNSWGQGTQVTVSSGGGGSGGGS<br>EVQLVESGGGLVQPGGSLRLSCAVSGSLFSARVMGWYRQAPGKQRELVAAITSG<br>VRTDYADSVKGRFTISRDNAKRAVYLQMNSLKPEDTAVYYCNVNLYNTGNYWGQ<br>GTQVTVSS |
| H33-14-L3-H33-<br>14-L1-hHS5-L1-<br>CD16F1-L3-<br>CD16F1<br>(SEQ ID NO: 138) | QVQLVESGGGLVQPGGSLRLSCAASGRTSLILAMAWWRQAPGKEREFAGRIWWN<br>NDMTRYSDSVKGRFTISRDNAKNTVYLQMSSLRAEDTAVYYCEADLIGGSRGWG<br>QGTQVTVSSAAAQVQLVESGGGLVQPGGSLRLSCAASGRTSLILAMAWWRQAPG<br>KEREFAGRIWWNNDMTRYSDSVKGRFTISRDNAKNTVYLQMSSLRAEDTAVYYC<br>EADLIGGSRGWGQGTQVTVSSGGGGSGGGSEVQLLESGGGLVQPGGSLRLSCAA<br>SGRTFTTHAMGWFRQAPGKEREFVSAINWGGRTTYYADSVKGRFIISRDTGANT<br>LYLQMNSLRAEDTAVYYCASNLDTYNVRAGTTNSWGQGTQVTVSSGGGGSGGGS<br>EVQLVESGGGLVQPGGSLRLSCAVSGSLFSARVMGWYRQAPGKQRELVAAITSG<br>VRTDYADSVKGRFTISRDNAKRAVYLQMNSLKPEDTAVYYCNVNLYNTGNYWGQ<br>GTQVTVSSAAAEVQLVESGGGLVQPGGSLRLSCAVSGSLFSARVMGWYRQAPGK<br>QRELVAAITSGVRTDYADSVKGRFTISRDNAKRAVYLQMNSLKPEDTAVYYCNV<br>NLYNTGNYWGQGTQVTVSS |
| hPL16-L1-hHS5-<br>L1-CD16F1<br>(SEQ ID NO: 139) | EVQLVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAAKRS<br>SEFDYWGQGTQVTVSSGGGGSGGGSEVQLLESGGGLVQPGGSLRLSCAASGRTF<br>TTHAMGWFRQAPGKEREFVSAINWGGRITYYADSVKGRFIISRDTGANTLYLQM<br>NSLRAEDTAVYYCASNLDTYNVRAGTTNSWGQGTQVTVSSGGGGSGGGSEVQLV<br>ESGGGLVQPGGSLRLSCAVSGSLFSARVMGWYRQAPGKQRELVAAITSGVRTDY<br>ADSVKGRFTISRDNAKRAVYLQMNSLKPEDTAVYYCNVNLYNTGNYWGQGTQVT<br>VSS |
| hPL16-L3-hPL16-<br>L1-hHS5-L1-<br>CD16F1<br>(SEQ ID NO: 140) | EVQLVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAAKRS<br>SEFDYWGQGTQVTVSSAAAEVQLVESGGGLVQPGGSLRLSCAASGGTFLTYSMS<br>WVRQAPGKEREFVSSINWSGYMTYYADSVKGRFTISRDNSKNTLYLQMNSLRAE<br>DTAVYYCAAARTAIAAKRSSEFDYWGQGTQVTVSSGGGGSGGGSEVQLLESGGG<br>LVQPGGSLRISCAASGRIFTTHAMGWFRQAPGKEREFVSAINWGGRTTYYADSV<br>KGRFIISRDTGANTLYLQMNSLRAEDTAVYYCASNLDTYNVRAGTTNSWGQGTQ<br>VTVSSGGGGSGGGSEVQLVESGGGLVQPGGSLRLSCAVSGSLFSARVMGWYRQA<br>PGKQRELVAAITSGVRTDYADSVKGRFTISRDNAKRAVYLQMNSLKPEDTAVYY<br>CNVNLYNTGNYWGQGTQVTVSS |
| hPL16-L1-hHS5-<br>L1-CD16F1-13-<br>CD16F1<br>(SEQ ID NO: 141) | EVQLVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAAKRS<br>SEFDYWGQGTQVTVSSGGGGSGGGSEVQLLESGGGLVQPGGSLRLSCAASGRTF<br>TTHAMGWFRQAPGKEREFVSAINWGGRTTYYADSVKGRFIISRDTGANTLYLQM<br>NSLRAEDTAVYYCASNLDTYNVRAGTINSWGQGTQVTVSSGGGGSGGGSEVQLV<br>ESGGGLVQPGGSLRLSCAVSGSLFSARVMGWYRQAPGKQRELVAAITSGVRTDY<br>ADSVKGRFTISRDNAKRAVYLQMNSLKPEDTAVYYCNVNLYNTGNYWGQGTQVT<br>VSSAAAEVQLVESGGGLVQPGGSLRLSCAVSGSLFSARVMGWYRQAPGKQRELV<br>AAITSGVRTDYADSVKGRFTISRDNAKRAVYLQMNSLKPEDTAVYYCNVNLYNT<br>GNYWGQGTQVTVSS |
| hPL16-L3-hPL16-<br>L1-hHS5-L1-<br>CD16F1-L3-<br>CD16F1 | EVQLVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAAKRS<br>SEFDYWGQGTQVTVSSAAAEVQLVESGGGLVQPGGSLRLSCAASGGTFLTYSMS<br>WVRQAPGKEREFVSSINWSGYMTYYADSVKGRFTISRDNSKNTLYLQMNSLRAE |

TABLE 16-continued

| Tri-specific molecules | |
|---|---|
| (SEQ ID NO: 142) | DTAVYYCAAARTAIAAKRSSEFDYWGQGTQVTVSSGGGGSGGGSEVQLLESGGG<br>LVQPGGSLRLSCAASGRTFTTHAMGWFRQAPGKEREFVSAINWGGRTTYYADSV<br>KGRFIISRDTGANTLYLQMNSLRAEDTAVYYCASNLDTYNVRAGTINSWGQGTQ<br>VTVSSGGGGSGGGSEVQLVESGGGLVQPGGSLRLSCAVSGSLFSARVMGWYRQA<br>PGKQRELVAAITSGVRTDYADSVKGRFTISRDNAKRAVYLQMNSLKPEDTAVYY<br>CNVNLYNTGNYWGQGTQVTVSSAAAEVQLVESGGGLVQPGGSLRLSCAVSGSLF<br>SARVMGWYRQAPGKQRELVAAITSGVRTDYADSVKGRFTISRDNAKRAVYLQMN<br>SLKPEDTAVYYCNVNLYNTGNYWGQGTQVTVSS |
| hLG9-L1-hHS5-<br>L1-hPL16(005R)<br>(SEQ ID NO: 143) | EVQLLESGGGLVQPGGSLRLSCAASGSTIDDYPMSWFRQAPGKGREGVAAIDDS<br>DESTYYADSVKGRFTISRDNSKNTLYLQMNSLRAEDTAVYYCARGAIFMIDGVD<br>VFLTYYYDSWGQGTLVTVSSGGGGSGGGSEVQLLESGGGLVQPGGSLRLSCAAS<br>GRTFTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGGGSE<br>VQLVESGGGLVQPGGSLRLSCAASGGTFLTYSMSWVRQAPGKEREFVSSINWSG<br>YMTYYADSVKGRFTISRDNSKNTLYLQMNSLRAEDTAVYYCAAARTAIAAKRSS<br>EFDYWGQGTQVTVSS |
| hLG9-L3-hLG9-<br>L1-hHS5-L1-<br>hPL16<br>(SEQ ID NO: 144) | EVQLLESGGGLVQPGGSLRLSCAASGSTIDDYPMSWFRQAPGKGREGVAAIDDS<br>DESTYYADSVKGRFTISRDNSKNTLYLQMNSLRAEDTAVYYCARGAIFMIDGVD<br>VFLTYYYDSWGQGTLVTVSSAAAEVQLLESGGGLVQPGGSLRLSCAASGSTIDD<br>YPMSWFRQAPGKGREGVAAIDDSDESTYYADSVKGRFTISRDNSKNTLYLQMNS<br>LRAEDTAVYYCARGAIFMIDGVDVFLTYYYDSWGQGTLVTVSSGGGGSGGGSEV<br>QLLESGGGLVQPGGSLRLSCAASGRTFTTHAMGWFRQAPGKEREFVSAINWGGR<br>TTYYADSVKGRFIISRDTGANTLYLQMNSLRAEDTAVYYCASNLDTYNVRAGTT<br>NSWGQGTQVTVSSGGGGSGGGSEVQLVESGGGLVQPGGSLRLSCAASGGTFLTY<br>SMSWVRQAPGKEREFVSSINWSGYMTYYADSVKGRFTISRDNSKNTLYLQMNSL<br>RAEDTAVYYCAAARTAIAAKRSSEFDYWGQGTQVTVSS |
| hLG9-L1-hHS5-<br>L1-hPL16-L3-<br>hPL16<br>(SEQ ID NO: 145) | EVQLLESGGGLVQPGGSLRLSCAASGSTIDDYPMSWFRQAPGKGREGVAAIDDS<br>DESTYYADSVKGRFTISRDNSKNTLYLQMNSLRAEDTAVYYCARGAIFMIDGVD<br>VFLTYYYDSWGQGTLVTVSSGGGGSGGGSEVQLLESGGGLVQPGGSLRLSCAAS<br>GRIFTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGGGSE<br>VQLVESGGGLVQPGGSLRLSCAASGGTFLTYSMSWVRQAPGKEREFVSSINWSG<br>YMTYYADSVKGRFTISRDNSKNTLYLQMNSLRAEDTAVYYCAAARTAIAAKRSS<br>EFDYWGQGTQVTVSSAAAEVQLVESGGGLVQPGGSLRLSCAASGGTFLTYSMSW<br>VRQAPGKEREFVSSINWSGYMTYYADSVKGRFTISRDNSKNTLYLQMNSLRAED<br>TAVYYCAAARTAIAAKRSSEFDYWGQGTQVTVSS |
| hLG9-L3-hLG9-<br>L1-hHS5-L1-<br>hPL16-L3-hPL16<br>(SEQ ID NO: 146) | EVQLLESGGGLVQPGGSLRLSCAASGSTIDDYPMSWFRQAPGKGREGVAAIDDS<br>DESTYYADSVKGRFTISRDNSKNTLYLQMNSLRAEDTAVYYCARGAIFMIDGVD<br>VFLTYYYDSWGQGTLVTVSSAAAEVQLLESGGGLVQPGGSLRLSCAASGSTIDD<br>YPMSWFRQAPGKGREGVAAIDDSDESTYYADSVKGRFTISRDNSKNTLYLQMNS<br>LRAEDTAVYYCARGAIFMIDGVDVFLTYYYDSWGQGTLVTVSSGGGGSGGGSEV<br>QLLESGGGLVQPGGSLRLSCAASGRTFTTHAMGWFRQAPGKEREFVSAINWGGR<br>TTYYADSVKGRFIISRDTGANTLYLQMNSLRAEDTAVYYCASNLDTYNVRAGTT<br>NSWGQGTQVTVSSGGGGSGGGSEVQLVESGGGLVQPGGSLRLSCAASGGTFLTY<br>SMSWVRQAPGKEREFVSSINWSGYMTYYADSVKGRFTISRDNSKNTLYLQMNSL<br>RAEDTAVYYCAAARTAIAAKRSSEFDYWGQGTQVTVSSAAAEVQLVESGGGLVQ<br>PGGSLRLSCAASGGTFLTYSMSWVRQAPGKEREFVSSINWSGYMTYYADSVKGR<br>FTISRDNSKNTLYLQMNSLRAEDTAVYYCAAARTAIAAKRSSEFDYWGQGTQVT<br>VSS |
| hPL16-L1-hHS5-<br>L1-hLG9<br>(SEQ ID NO: 147) | EVQLVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAAKRS<br>SEFDYWGQGTQVTVSSGGGGSGGGSEVQLLESGGGLVQPGGSLRLSCAASGRTF<br>TTHAMGWFRQAPGKEREFVSAINWGGRTTYYADSVKGRFIISRDTGANTLYLQM<br>NSLRAEDTAVYYCASNLDTYNVRAGTTNSWGQGTQVTVSSGGGGSGGGSEVQLL<br>ESGGGLVQPGGSLRLSCAASGSTIDDYPMSWFRQAPGKGREGVAAIDDSDESTY<br>YADSVKGRFTISRDNSKNTLYLQMNSLRAEDTAVYYCARGAIFMIDGVDVFLTY<br>YYDSWGQGTLVTVSS |
| hPL16-L1-hHS5-<br>L1-hLG9-L3-<br>hLG9<br>(SEQ ID NO: 148) | EVQLVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAAKRS<br>SEFDYWGQGTQVTVSSGGGGSGGGSEVQLLESGGGLVQPGGSLRLSCAASGRTF<br>TTHAMGWFRQAPGKEREFVSAINWGGRTTYYADSVKGRFIISRDTGANTLYLQM<br>NSLRAEDTAVYYCASNLDTYNVRAGTTNSWGQGTQVTVSSGGGGSGGGSEVQLL<br>ESGGGLVQPGGSLRLSCAASGSTIDDYPMSWFRQAPGKGREGVAAIDDSDESTY<br>YADSVKGRFTISRDNSKNTLYLQMNSLRAEDTAVYYCARGAIFMIDGVDVFLTY<br>YYDSWGQGTLVTVSSAAAEVQLLESGGGLVQPGGSLRLSCAASGSTIDDYPMSW<br>FRQAPGKGREGVAAIDDSDESTYYADSVKGRFTISRDNSKNTLYLQMNSLRAED<br>TAVYYCARGAIFMIDGVDVFLTYYYDSWGQGTLVTVSS |
| hPL16-13-hPL16-<br>L1-hHS5-L1-<br>hLG9<br>(SEQ ID NO: 149) | EVQLVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAAKRS<br>SEFDYWGQGTQVTVSSAAAEVQLVESGGGLVQPGGSLRLSCAASGGTFLTYSMS<br>WVRQAPGKEREFVSSINWSGYMTYYADSVKGRFTISRDNSKNTLYLQMNSLRAE |

TABLE 16-continued

| Tri-specific molecules | |
|---|---|
| | DTAVYYCAAARTAIAAKRSSEFDYWGQGTQVTVSSGGGGSGGGSEVQLLESGGG LVQPGGSLRLSCAASGRTFTTHAMGWFRQAPGKEREFVSAINWGGRTTYYADSV KGRFIISRDTGANTLYLQMNSLRAEDTAVYYCASNLDTYNVRAGTTNSWGQGTQ VTVSSGGGGSGGGSEVQLLESGGGLVQPGGSLRLSCAASGSTIDDYPMSWFRQA PGKGREGVAAIDDSDESTYYADSVKGRFTISRDNSKNTLYLQMNSLRAEDTAVY YCARGAIFMIDGVDVFLTYYYDSWGQGTLVTVSS |
| hPL16-L3-hPL16-L1-hHS5-L1-hLG9-L3-hLG9 (SEQ ID NO: 150) | EVQLVESGGGLVQPGGSLRLSCAASGGTFLTYSMSWVRQAPGKEREFVSSINWS GYMTYYADSVKGRFTISRDNSKNTLYLQMNSLRAEDTAVYYCAAARTAIAAKRS SEFDYWGQGTQVTVSSAAAEVQLVESGGGLVQPGGSLRLSCAASGGTFLTYSMS WVRQAPGKEREFVSSINWSGYMTYYADSVKGRFTISRDNSKNTLYLQMNSLRAE DTAVYYCAAARTAIAAKRSSEFDYWGQGTQVTVSSGGGGSGGGSEVQLLESGGG LVQPGGSLRLSCAASGRTFTTHAMGWFRQAPGKEREFVSAINWGGRTTYYADSV KGRFIISRDTGANTLYLQMNSLRAEDTAVYYCASNLDTYNVRAGTTNSWGQGTQ VTVSSGGGGSGGGSEVQLLESGGGLVQPGGSLRLSCAASGSTIDDYPMSWFRQA PGKGREGVAAIDDSDESTYYADSVKGRFTISRDNSKNTLYLQMNSLRAEDTAVY YCARGAIFMIDGVDVFLTYYYDSWGQGTLVTVSSAAAEVQLLESGGGLVQPGGS LRLSCAASGSTIDDYPMSWFRQAPGKGREGVAAIDDSDESTYYADSVKGRFTIS RDNSKNTLYLQMNSLRAEDTAVYYCARGAIFMIDGVDVFLTYYYDSWGQGTLVT VSS |

Figure 14A:
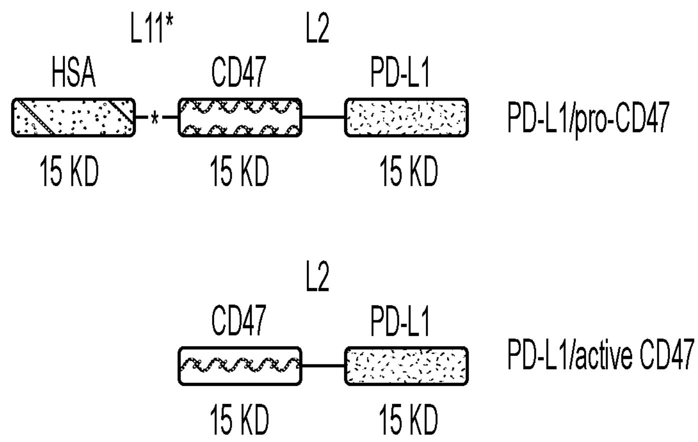
FIG. 14A-B) depicts a tri-specific molecule format (FIG. 14A) and SDS-PAGE analysis of pro-CD47 activated by tumor proteases (FIG. 14B).
Figure 14B:
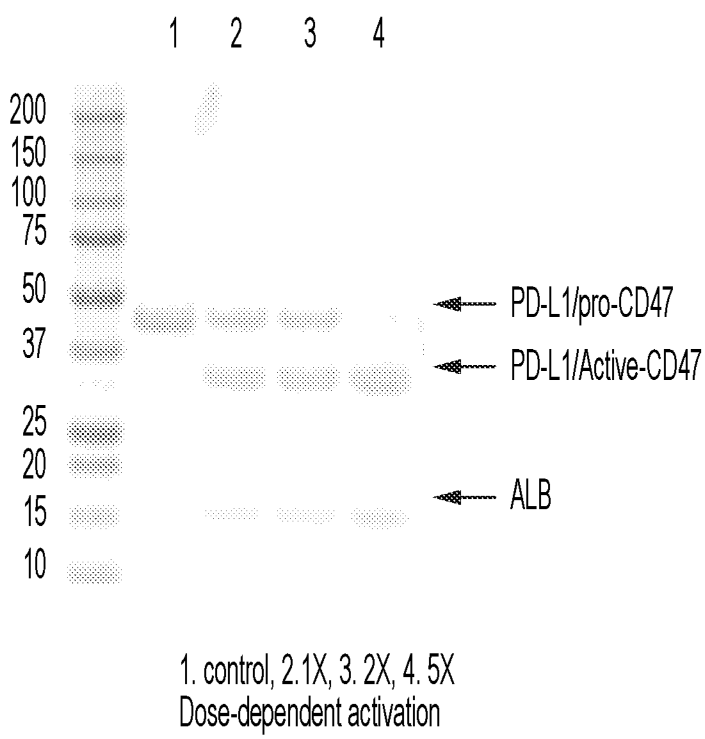

The anti-HSA domain, by binding to HSA, can prolong the half-life of the MVSCA in the body. It may also interfere with the activity of the other domains, which can in some cases be desirable for the MVSCA as distributed throughout the body, but is not desirable when the MVSCA is at its site of intended action, for example, a tumor. Thus by connecting the anti-HSA domain to the other antigen binding domain(s) by a cleavable linker that can be preferentially cleaved at the intended site of action. In this manner the MVSCA can serve as a pro-drug. One such MVSCA with a linker containing a protease cleavable sequence, was used between HSA VHH and CD47 VHH or LAG3 VHH and a different linker was used to connect CD47 VHH with the PD-L1 VHH or connect LAG3 VHH with PD-L1 is depicted in FIG. 13 and Table 9. FIG. 14B shows SDS-page analysis following protease digestion of the antibody of FIG. 14A.

Proteases Assays (1) MMP-9 Activity Assay. Recombinant human MMP-9 (rhMMP-9, R&D Systems) is diluted to 100 μg/ml in assay buffer (50 mM Tris, 10 mM $CaCl_2$), 150 mM NaCl, 0.05% Brij-35, pH7.5). rhMMP-9 is then activated by adding APMA (p-aminophenylmercuric acetate, Sigma) to final concentration of 1 mM and incubated at 37° C. for 24 hr. Activated rhMMP-9 is titrated with an equal volume of 20 UM antibody in assay buffer and incubate at room temperature for 1 hr. The resultant digested substrate is analyzed by SDS-PAGE.

(2) u-Plasminogen Activator (uPA, urokinase) Activity Assay. The substrate is diluted to 200 UM in assay buffer (50 mM Tris, 0.01% TWEEN® 20, pH8.5) and titrated with an equal volume of recombinant human u-Plasminogen Activator (rhuPA, R&D Systems) in assay buffer. The reaction mixture is incubated at room temperature for 1-2 hr and the resultant digested substrate is analyzed by SDS-PAGE.

(3) Matriptase Activity Assay. The substrate is diluted to 200 μM in assay buffer (50 mM Tris, 50 mM NaCl, 0.01% TWEEN® 20,) and titrated with an equal volume of recombinant human matriptase (R&D Systems) in assay buffer. The reaction mixture is incubated at room temperature for 1-2 hr and the resultant digested substrate is analyzed by SDS-PAGE.

Polyacrylamide gel electrophoresis (SDS-PAGE). Denaturing SDS-PAGE is performed according to the Invitrogen NUPAGE® specifications. In brief, 7.5 μL of protein sample (3 μg protein) are mixed with 2.5 μL of 4×LDS sample loading buffer (Invitrogen) and heated at 70° C. for 10 min. Samples are then loaded into precast NUPAGE® NOVEX® 4-12% Bis-Tris 1.0 mm minigels (Invitrogen). Then, 5 μL of pre-stained SDS-PAGE Standards (Bio-Rad) are loaded in each gel run. Electrophoresis is performed at room temperature for approximately 45 min using a constant voltage (200V) in 1×solution of NUPAGER MOPS SDS running buffer (Invitrogen) until the dye front reached the end of the 60 mm gel. Gels are stained with SIMPLYBLUE™ SafeStain (Invitrogen).

Figure 15:
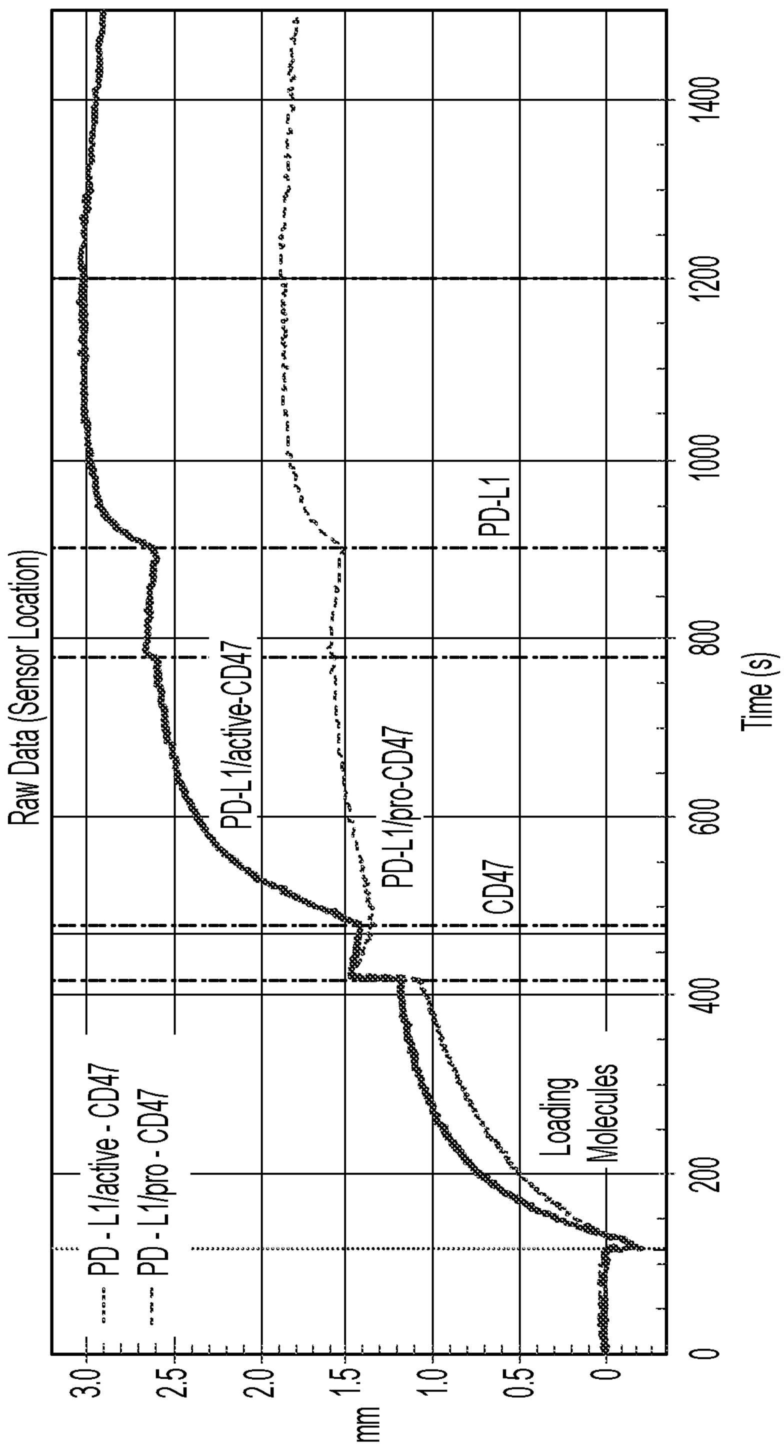
FIG. 15 depicts real-time kinetic OCTET® binding analysis of PD-L1/pro-CD47 vs PD-L1/active-CD47.

FIG. 15 depicts real time kinetic binding analysis of PD-L1/pro-CD47 (HSA-CD47-PD-L1 antibody) vs PD-L1/active-CD47 (same antibody with the HSA binding domain cleaved off) in the presence of 10 mg/ml HSA. PD-L1/pro-CD47 has no, or much less, binding to CD47, whereas PD-L1/active CD47 showed robust binding to CD47. There are no differences or impact on PD-L1 binding in this assay.

Example 8. Multi-Specific Molecules Containing CD16A/HSA/CD47/(PD-L1 or CD33)

Figure 16:
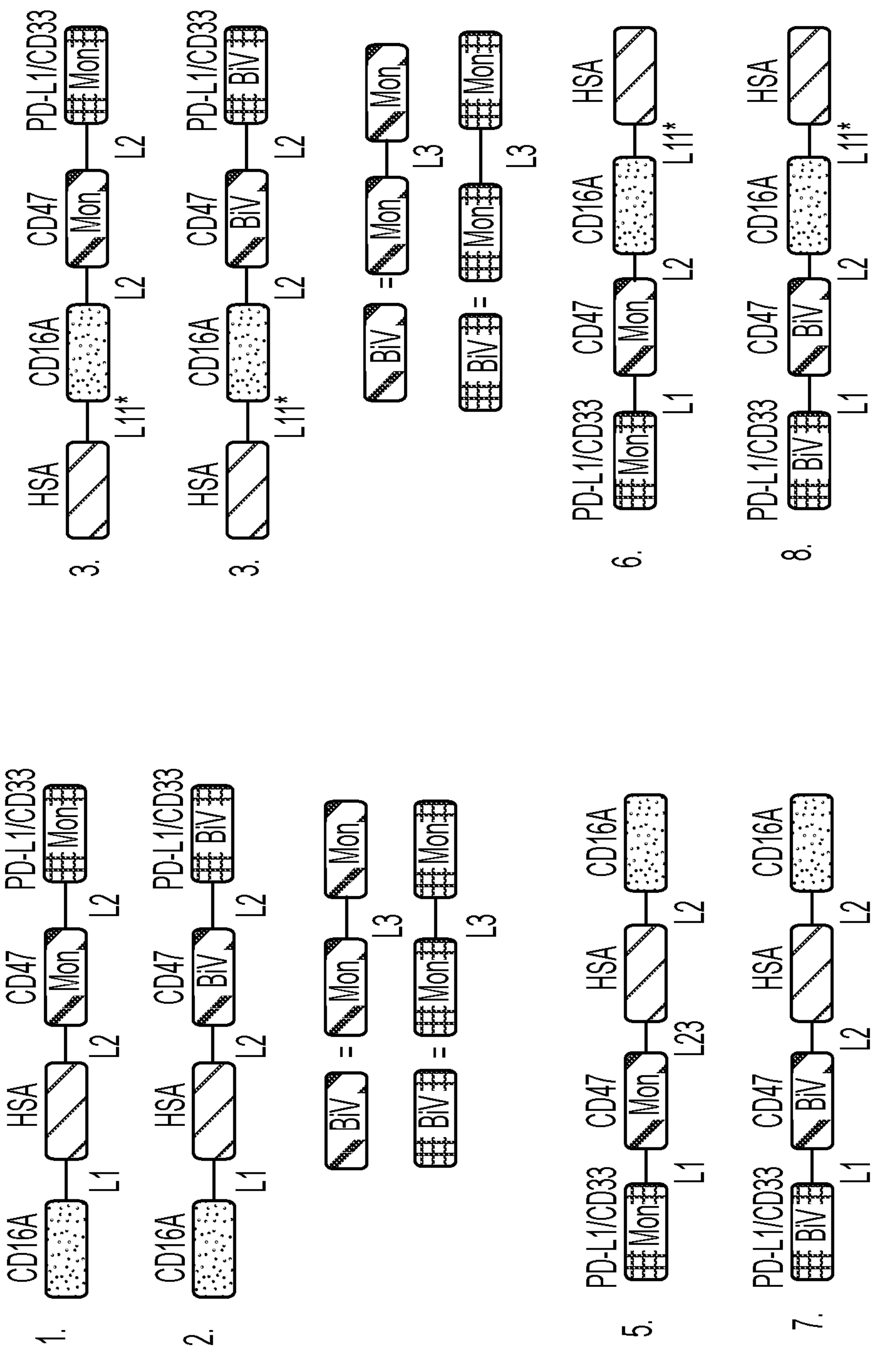
FIG. 16 depicts the format of the multi-specific molecules. Mon=monovalent binding domain; BiV=bivalent binding domain comprising two identical monovalent binding domains.

To construct a multi-specific molecule, ant-CD16A, anti-HSA, anti-CD47, and anti-PD-L1 or CD33 VHH sequences were fused together via linkers in eight different ways by recombinant DNA technology. FIG. 16 depicts the structures of exemplary multi-specific molecules of anti-CD16A, anti-HSA, anti-CD47, and anti-PD-L1 or CD33 VHH. The amino acid sequences of exemplary multi-specific molecules listed below (Table 17)

FIG. 17A compared the length of the linker between VHH2 and VHH3, $G_4SG_3S$ (L1, SEQ ID NO:100) vs $(G_4S)_3$ (L4, SEQ ID NO:103), in a flow cytometry binding assay on HL60 cells. The HL60 cells express CD47 but not PD-L1, therefore the binding of 1518-HS5 (SEQ ID 173) and 1518-HS5-GS15 (SEQ ID 184) indicated the two molecules binding to the CD47 on the HL60 cell surface (FIG. 18). The longer linker such as $(G_4S)_3$ (SEQ ID NO:103, GS15 stands for a 15 amino acid linker) vs $G_4SG_3S$ (SEQ ID NO:101, 9 amino acids) improved the CD47 binding, EC50 8.4 vs 26 nM.

TABLE 17

| Multi-specific Molecules | |
|---|---|
| hPL16-L1-hHS5-L1-CD16F1 (SEQ ID NO: 151) | EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTLVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS |
| CD16F1-L1-hHS10-L1-hA09-10-2-L3-A09-10-L1-hPL16 (015-3) (SEQ ID NO: 152) | EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEEVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS |
| hHS10-L11*12-CD16F1-L1-hA09-10-2-L3-A09-10-L1-hPL16 (SEQ ID NO: 153) | EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS |
| CD16F1-L1-hHS10-L1-A09-10-L1-hPL16 (015-2) (SEQ ID NO: 154) | EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSQVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS |
| hHS10-L11*12-CD16F1-L1-hA09-10-2-L3-A09-10-L1-hPL16-L3-hPL16 (SEQ ID NO: 155) | EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS |
| CD16F1-L1-hHS10-L1-hA09-10-2-L3-A09-10-L1-hPL16-L3-hPL16 (1511) (SEQ ID NO: 156) | EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTY |

TABLE 17-continued

| Multi-specific Molecules | |
|---|---|
| | SMSWVRQAPGKEREFVSSINWSGYMTYYADSVKGRFTISRDNSKNTLYLQM<br>NSLRAEDTAVYYCAAARTAIAAKRSSEFDYWGQGTQVTVSSAAAEVQLVES<br>GGGLVQPGGSLRLSCAASGGTFLTYSMSWVRQAPGKEREFVSSINWSGYMT<br>YYADSVKGRFTISRDNSKNTLYLQMNSLRAEDTAVYYCAAARTAIAAKRSS<br>EFDYWGQGTQVTVSS |
| CD16F1-L1-hHS10-L1-<br>hA09-10-3-L3-hA09-<br>10-4-L1-hPL16-L3-<br>hPL16<br>(1518)<br>(SEQ ID NO: 157) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLVESGGGLVQPGGSLRLSCAASGST<br>DSAYRMGWFRQAPGKEREFVSAINWSDGRTYYADSVKGRFTISRDNSKNTL<br>YLQMNSLRAEDTAVYYCAADPDSRLYYTVPQNYDYWGQGTLVTVSSGGGGS<br>GGGSEVQLVESGGGLVQPGGSLRLSCAASGGGRTFSNYALGWFRQAPGKER<br>EFVAAISRSGGNINYADSVKGRFTISRDNFKNTVYLQMSSLRAEDTAVYYC<br>AAHYLLLPSYISTSTNMYNYWGQGTQVTVSSAAAQVQLVESGGGLVQPGGS<br>LRLSCAASGGGRTFSNYALGWFRQAPGKEREFVAAISRSGGNINYADSVKG<br>RFTISRDNAKNTVYLQMSSLRAEDTAVYYCAAHYLLLPSYISTSTNMYNYW<br>GQGTQVTVSSGGGGSGGGSEVQLVESGGGLVQPGGSLRLSCAASGGTFLTY<br>SMSWVRQAPGKEREFVSSINWSGYMTYYADSVKGRFTISRDNSKNTLYLQM<br>NSLRAEDTAVYYCAAARTAIAAKRSSEFDYWGQGTQVTVSSAAAEVQLVES<br>GGGLVQPGGSLRLSCAASGGTFLTYSMSWVRQAPGKEREFVSSINWSGYMT<br>YYADSVKGRFTISRDNSKNTLYLQMNSLRAEDTAVYYCAAARTAIAAKRSS<br>EFDYWGQGTQVTVSS |
| hHS10-L11*9-CD16F1-<br>L1-hA09-10-2-L3-A09-<br>10-L1- H33-14-L3-H33-<br>14<br>(SEQ ID NO: 158) | EVQLVESGGGLVQPGGSLRLSCAASGSTDSAYRMGWFRQAPGKEREFVSAI<br>NWSDGRTYYADSVKGRFTISRDNSKNTLYLQMNSLRAEDTAVYYCAADPDS<br>RLYYTVPQNYDYWGQGTLVTVSSGGSGRSAPLGLARQARQVGGSEVQLVES<br>GGGLVQPGGSLRLSCAVSGSLFSARVMGWYRQAPGKQRELVAAITSGVRTD<br>YADSVKGRFTISRDNAKRAVYLQMNSLKPEDTAVYYCNVNLYNTGNYWGQG<br>TQVTVSSGGGGSGGGSEVQLVESGGGLVQPGGSLRLSCAASGGGRTFSNYA<br>LGWFRQAPGKEREFVAAISRSGGNINYADSVKGRFTISRDNFKNTTYLQMS<br>SLEPEDTAVYYCAAHYLLLPSYISTSTNMYNYWGQGTQVTVSSAAAQVQLV<br>ESGGGLVQAGGSLRLSCAASGGGRTFSNYALGWFRQAPGKEREFVAAISRS<br>GGNINYADSVKGRFTISRDNFKNTTYLQMSSLEPEDTAVYYCAAHYLLLPS<br>YISTSTNMYNYWGQGTQVTVSSGGGGSGGGSQVQLVESGGGLVQPGGSLRL<br>SCAASGRTSLILAMAWWRQAPGKEREFAGRIWWNNDMTRYSDSVKGRFTIS<br>RDNAKNTVYLQMSSLRAEDTAVYYCEADLIGGSRGWGQGTLVTVSSAAAQV<br>QLVESGGGLVQPGGSLRLSCAASGRTSLILAMAWWRQAPGKEREFAGRIWW<br>NNDMTRYSDSVKGRFTISRDNAKNTVYLQMSSLRAEDTAVYYCEADLIGGS<br>RGWGQGTLVTVSS |
| CD16F1-L1-hHS10-L1-<br>hA09-10-3-L3-hA09-<br>10-4-L1-H33-14-L3-<br>H33-14<br>(3321)<br>(SEQ ID NO: 159) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLVESGGGLVQPGGSLRLSCAASGST<br>DSAYRMGWFRQAPGKEREFVSAINWSDGRTYYADSVKGRFTISRDNSKNTL<br>YLQMNSLRAEDTAVYYCAADPDSRLYYTVPQNYDYWGQGTLVTVSSGGGGS<br>GGGSEVQLVESGGGLVQPGGSLRLSCAASGGGRTFSNYALGWFRQAPGKER<br>EFVAAISRSGGNINYADSVKGRFTISRDNFKNTVYLQMSSLRAEDTAVYYC<br>AAHYLLLPSYISTSTNMYNYWGQGTQVTVSSAAAQVQLVESGGGLVQPGGS<br>LRLSCAASGGGRTFSNYALGWFRQAPGKEREFVAAISRSGGNINYADSVKG<br>RFTISRDNAKNTVYLQMSSLRAEDTAVYYCAAHYLLLPSYISTSTNMYNYW<br>GQGTQVTVSSGGGGSGGGSQVQLVESGGGLVQPGGSLRLSCAASGRTSLIL<br>AMAWWRQAPGKEREFAGRIWWNNDMTRYSDSVKGRFTISRDNAKNTVYLQM<br>SSLRAEDTAVYYCEADLIGGSRGWGQGTLVTVSSAAAQVQLVESGGGLVQP<br>GGSLRLSCAASGRTSLILAMAWWRQAPGKEREFAGRIWWNNDMTRYSDSVK<br>GRFTISRDNAKNTVYLQMSSLRAEDTAVYYCEADLIGGSRGWGQGTLVTVS<br>S |
| hHS10-L11*9-CD16F1-<br>L1-CD16F1-L1- hA09-<br>10-2-L3-A09-10-L1-<br>hPL-16-L3-hPL-16<br>(SEQ ID NO: 160) | EVQLVESGGGLVQPGGSLRLSCAASGSTDSAYRMGWFRQAPGKEREFVSAI<br>NWSDGRTYYADSVKGRFTISRDNSKNTLYLQMNSLRAEDTAVYYCAADPDS<br>RLYYTVPQNYDYWGQGTLVTVSSGGSGRSAPLGLARQARQVGGSEVQLVES<br>GGGLVQPGGSLRLSCAVSGSLFSARVMGWYRQAPGKQRELVAAITSGVRTD<br>YADSVKGRFTISRDNAKRAVYLQMNSLKPEDTAVYYCNVNLYNTGNYWGQG<br>TQVTVSSGGGGSGGGSEVQLVESGGGLVQPGGSLRLSCAVSGSLFSARVMG<br>WYRQAPGKQRELVAAITSGVRTDYADSVKGRFTISRDNAKRAVYLQMNSLK<br>PEDTAVYYCNVNLYNTGNYWGQGTQVTVSSGGGGSGGGSEVQLVESGGGLV<br>QPGGSLRLSCAASGGGRTFSNYALGWFRQAPGKEREFVAAISRSGGNINYA<br>DSVKGRFTISRDNFKNTTYLQMSSLEPEDTAVYYCAAHYLLLPSYISTSTN<br>MYNYWGQGTQVTVSSAAAQVQLVESGGGLVQAGGSLRLSCAASGGGRTFSN<br>YALGWFRQAPGKEREFVAAISRSGGNINYADSVKGRFTISRDNFKNTTYLQ<br>MSSLEPEDTAVYYCAAHYLLLPSYISTSTNMYNYWGQGTQVTVSSGGGGSG<br>GGSEVQLVESGGGLVQPGGSLRLSCAASGGTFLTYSMSWVRQAPGKEREFV<br>SSINWSGYMTYYADSVKGRFTISRDNSKNTLYLQMNSLRAEDTAVYYCAAA<br>RTAIAAKRSSEFDYWGQGTQVTVSSAAAEVQLVESGGGLVQPGGSLRLSCA<br>ASGGTFLTYSMSWVRQAPGKEREFVSSINWSGYMTYYADSVKGRFTISRDN<br>SKNTLYLQMNSLRAEDTAVYYCAAARTAIAAKRSSEFDYWGQGTQVTVSS |
| CD16F1-L3-CD16F1-<br>L1-hHS10-L1-hA09-10-<br>2-L3-A09-10-L1-H33- | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSAAAEVQLVESGGGLVQPGGSLRLSCAVSGSLFSARVM |

TABLE 17-continued

| Multi-specific Molecules | |
|---|---|
| 14-L3-H33-14<br>(SEQ ID NO: 161) | GWYRQAPGKQRELVAAITSGVRTDYADSVKGRFTISRDNAKRAVYLQMNSL<br>KPEDTAVYYCNVNLYNTGNYWGQGTQVTVSSGGGGSGGGSEVQLVESGGGL<br>VQPGGSLRLSCAASGSTDSAYRMGWFRQAPGKEREFVSAINWSDGRTYYAD<br>SVKGRFTISRDNSKNTLYLQMNSLRAEDTAVYYCAADPDSRLYYTVPQNYD<br>YWGQGTLVTVSSGGGGSGGGSEVQLVESGGGLVQPGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSAAA<br>QVQLVESGGGLVQAGGSLRLSCAASGGGRTFSNYALGWFRQAPGKEREFVA<br>AISRSGGNINYADSVKGRFTISRDNFKNTTYLQMSSLEPEDTAVYYCAAHY<br>LLLPSYISTSTNMYNYWGQGTQVTVSSGGGGSGGGSQVQLVESGGGLVQPG<br>GSLRLSCAASGRTSLILAMAWWRQAPGKEREFAGRIWWNNDMTRYSDSVKG<br>RFTISRDNAKNTVYLQMSSLRAEDTAVYYCEADLIGGSRGWGQGTLVTVSS<br>AAAQVQLVESGGGLVQPGGSLRLSCAASGRTSLILAMAWWRQAPGKEREFA<br>GRIWWNNDMTRYSDSVKGRFTISRDNAKNTVYLQMSSLRAEDTAVYYCEAD<br>LIGGSRGWGQGTLVTVSS |
| hHS10-L11*12-<br>CD16F1-L3-CD16F1-<br>L1- hA09-10-2-L3-A09-<br>10-L1-H33-14-L3-H33-<br>14<br>(SEQ ID NO: 162) | EVQLVESGGGLVQPGGSLRLSCAASGSTDSAYRMGWFRQAPGKEREFVSAI<br>NWSDGRTYYADSVKGRFTISRDNSKNTLYLQMNSLRAEDTAVYYCAADPDS<br>RLYYTVPQNYDYWGQGTLVTVSSGGSGRSAPLGLARQARQVGGSEVQLVES<br>GGGLVQPGGSLRLSCAVSGSLFSARVMGWYRQAPGKQRELVAAITSGVRTD<br>YADSVKGRFTISRDNAKRAVYLQMNSLKPEDTAVYYCNVNLYNTGNYWGQG<br>TQVTVSSAAAEVQLVESGGGLVQPGGSLRLSCAVSGSLFSARVMGWYRQAP<br>GKQRELVAAITSGVRTDYADSVKGRFTISRDNAKRAVYLQMNSLKPEDTAV<br>YYCNVNLYNTGNYWGQGTQVTVSSGGGGSGGGSEVQLVESGGGLVQPGGSL<br>RLSCAASGGGRTFSNYALGWFRQAPGKEREFVAAISRSGGNINYADSVKGR<br>FTISRDNFKNTTYLQMSSLEPEDTAVYYCAAHYLLLPSYISTSTNMYNYWG<br>QGTQVTVSSAAAQVQLVESGGGLVQAGGSLRLSCAASGGGRTFSNYALGWF<br>RQAPGKEREFVAAISRSGGNINYADSVKGRFTISRDNFKNTTYLQMSSLEP<br>EDTAVYYCAAHYLLLPSYISTSTNMYNYWGQGTQVTVSSGGGGSGGGSQVQ<br>LVESGGGLVQPGGSLRLSCAASGRTSLILAMAWWRQAPGKEREFAGRIWWN<br>NDMTRYSDSVKGRFTISRDNAKNTVYLQMSSLRAEDTAVYYCEADLIGGSR<br>GWGQGTLVTVSSAAAQVQLVESGGGLVQPGGSLRLSCAASGRTSLILAMAW<br>WRQAPGKEREFAGRIWWNNDMTRYSDSVKGRFTISRDNAKNTVYLQMSSLR<br>AEDTAVYYCEADLIGGSRGWGQGTLVTVSS |
| CD16F1-L3-CD16F1-<br>L1- hA09-10-2-L3-A09-<br>10-L1-H33-14-L3-H33-<br>14<br>(SEQ ID NO: 163) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSAAAEVQLVESGGGLVQPGGSLRLSCAVSGSLFSARVM<br>GWYRQAPGKQRELVAAITSGVRTDYADSVKGRFTISRDNAKRAVYLQMNSL<br>KPEDTAVYYCNVNLYNTGNYWGQGTQVTVSSGGGGSGGGSEVQLVESGGGL<br>VQPGGSLRLSCAASGGGRTFSNYALGWFRQAPGKEREFVAAISRSGGNINY<br>ADSVKGRFTISRDNFKNTTYLQMSSLEPEDTAVYYCAAHYLLLPSYISTST<br>NMYNYWGQGTQVTVSSAAAQVQLVESGGGLVQAGGSLRLSCAASGGGRTFS<br>NYALGWFRQAPGKEREFVAAISRSGGNINYADSVKGRFTISRDNFKNTTYL<br>QMSSLEPEDTAVYYCAAHYLLLPSYISTSTNMYNYWGQGTQVTVSSGGGGS<br>GGGSQVQLVESGGGLVQPGGSLRLSCAASGRTSLILAMAWWRQAPGKEREF<br>AGRIWWNNDMTRYSDSVKGRFTISRDNAKNTVYLQMSSLRAEDTAVYYCEA<br>DLIGGSRGWGQGTLVTVSSAAAQVQLVESGGGLVQPGGSLRLSCAASGRTS<br>LILAMAWWRQAPGKEREFAGRIWWNNDMTRYSDSVKGRFTISRDNAKNTVY<br>LQMSSLRAEDTAVYYCEADLIGGSRGWGQGTLVTVSS |
| H33-14-L3-H33-14-L1-<br>hA09-10-2-L3-A09-10-<br>L1-hHS10-L1-CD16F1<br>(SEQ ID NO: 164) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG<br>GSGGGSEVQLVESGGGLVQPGGSLRLSCAASGSTDSAYRMGWFRQAPGKER<br>EFVSAINWSDGRTYYADSVKGRFTISRDNSKNTLYLQMNSLRAEDTAVYYC<br>AADPDSRLYYTVPQNYDYWGQGTLVTVSSGGGGSGGGSEVQLVESGGGLVQ<br>PGGSLRLSCAVSGSLFSARVMGWYRQAPGKQRELVAAITSGVRTDYADSVK<br>GRFTISRDNAKRAVYLQMNSLKPEDTAVYYCNVNLYNTGNYWGQGTQVTVS<br>S |
| H33-14-L3-H33-14-L1-<br>hA09-10-2-L3-A09-10-<br>L1-hHS10-L1-CD16F1-<br>L3-CD16F1<br>(SEQ ID NO: 165) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG |

TABLE 17-continued

| Multi-specific Molecules | |
|---|---|
| | GSGGGSEVQLVESGGGLVQPGGSLRLSCAASGSTDSAYRMGWFRQAPGKER<br>EFVSAINWSDGRTYYADSVKGRFTISRDNSKNTLYLQMNSLRAEDTAVYYC<br>AADPDSRLYYTVPQNYDYWGQGTLVTVSSGGGGSGGGSEVQLVESGGGLVQ<br>PGGSLRLSCAVSGSLFSARVMGWYRQAPGKQRELVAAITSGVRTDYADSVK<br>GRFTISRDNAKRAVYLQMNSLKPEDTAVYYCNVNLYNTGNYWGQGTQVTVS<br>SAAAEVQLVESGGGLVQPGGSLRLSCAVSGSLFSARVMGWYRQAPGKQREL<br>VAAITSGVRTDYADSVKGRFTISRDNAKRAVYLQMNSLKPEDTAVYYCNVN<br>LYNTGNYWGQGTQVTVSS |
| H33-14-L3-H33-14-L1-<br>hA09-10-2-L3-A09-10-<br>L1-CD16F1-L11*9-<br>hHS10<br>(SEQ ID NO: 166) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG<br>GSGGGSEVQLVESGGGLVQPGGSLRLSCAVSGSLFSARVMGWYRQAPGKQR<br>ELVAAITSGVRTDYADSVKGRFTISRDNAKRAVYLQMNSLKPEDTAVYYCN<br>VNLYNTGNYWGQGTQVTVSSGGSGRSAPLGLARQARQVGGSEVQLVESGGG<br>LVQPGGSLRLSCAASGSTDSAYRMGWFRQAPGKEREFVSAINWSDGRTYYA<br>DSVKGRFTISRDNSKNTLYLQMNSLRAEDTAVYYCAADPDSRLYYTVPQNY<br>DYWGQGTLVTVSS |
| H33-14-L3-H33-14-L1-<br>hA09-10-2-L3-A09-10-<br>L1-CD16-F1-L3-<br>CD16F1-L11*9-hHS10<br>(SEQ ID NO: 167) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG<br>GSGGGSEVQLVESGGGLVQPGGSLRLSCAVSGSLFSARVMGWYRQAPGKQR<br>ELVAAITSGVRTDYADSVKGRFTISRDNAKRAVYLQMNSLKPEDTAVYYCN<br>VNLYNTGNYWGQGTQVTVSSAAAEVQLVESGGGLVQPGGSLRLSCAVSGSL<br>FSARVMGWYRQAPGKQRELVAAITSGVRTDYADSVKGRFTISRDNAKRAVY<br>LQMNSLKPEDTAVYYCNVNLYNTGNYWGQGTQVTVSSGGSGRSAPLGLARQ<br>ARQVGGSEVQLVESGGGLVQPGGSLRLSCAASGSTDSAYRMGWFRQAPGKE<br>REFVSAINWSDGRTYYADSVKGRFTISRDNSKNTLYLQMNSLRAEDTAVYY<br>CAADPDSRLYYTVPQNYDYWGQGTLVTVSS |
| CD16F1-L1-hHS5-L1-<br>hA09-10-2-L3-A09-10-<br>L1-hPL16<br>(015-3-HS5)<br>(SEQ ID NO: 168) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GSEVQLVESGGGLVQPGGSLRLSCAASGGGRTFSNYALGWFRQAPGKEREF<br>VAAISRSGGNINYADSVKGRFTISRDNFKNTTYLQMSSLEPEDTAVYYCAA<br>HYLLLPSYISTSTNMYNYWGQGTQVTVSSAAAQVQLVESGGGLVQAGGSLR<br>LSCAASGGGRTFSNYALGWFRQAPGKEREFVAAISRSGGNINYADSVKGRF<br>TISRDNFKNTTYLQMSSLEPEDTAVYYCAAHYLLLPSYISTSTNMYNYWGQ<br>GTQVTVSSGGGGSGGGSEVQLVESGGGLVQPGGSLRLSCAASGGTFLTYSM<br>SWVRQAPGKEREFVSSINWSGYMTYYADSVKGRFTISRDNSKNTLYLQMNS<br>LRAEDTAVYYCAAARTAIAAKRSSEFDYWGQGTQVTVSS |
| hHS5-L11*9-CD16F1-<br>L1- hA09-10-2-L3-A09-<br>10-L1-hPL16<br>(SEQ ID NO: 169) | EVQLLESGGGLVQPGGSLRLSCAASGRTFTTHAMGWFRQAPGKEREFVSAI<br>NWGGRTTYYADSVKGRFIISRDTGANTLYLQMNSLRAEDTAVYYCASNLDT<br>YNVRAGTTNSWGQGTQVTVSSGGSGRSAPLGLARQARQVGGSEVQLVESGG<br>GLVQPGGSLRLSCAVSGSLFSARVMGWYRQAPGKQRELVAAITSGVRTDYA<br>DSVKGRFTISRDNAKRAVYLQMNSLKPEDTAVYYCNVNLYNTGNYWGQGTQ<br>VTVSSGGGGSGGGSEVQLVESGGGLVQPGGSLRLSCAASGGGRTFSNYALG<br>WFRQAPGKEREFVAAISRSGGNINYADSVKGRFTISRDNFKNTTYLQMSSL<br>EPEDTAVYYCAAHYLLLPSYISTSTNMYNYWGQGTQVTVSSAAAQVQLVES<br>GGGLVQAGGSLRLSCAASGGGRTFSNYALGWFRQAPGKEREFVAAISRSGG<br>NINYADSVKGRFTISRDNFKNTTYLQMSSLEPEDTAVYYCAAHYLLLPSYI<br>STSTNMYNYWGQGTQVTVSSGGGGSGGGSEVQLVESGGGLVQPGGSLRLSC<br>AASGGTFLTYSMSWVRQAPGKEREFVSSINWSGYMTYYADSVKGRFTISRD<br>NSKNTLYLQMNSLRAEDTAVYYCAAARTAIAAKRSSEFDYWGQGTQVTVSS |
| CD16F1-L1-hHS5-L1-<br>A09-10-L1-hPL16<br>(015-2-HS5)<br>(SEQ ID NO: 170) | EVQLLESGGGLVQPGGSLRLSCAASGRTFTTHAMGWFRQAPGKEREFVSAI<br>NWGGRTTYYADSVKGRFIISRDTGANTLYLQMNSLRAEDTAVYYCASNLDT<br>YNVRAGTTNSWGQGTQVTVSSGGGGSGGGSEVQLLESGGGLVQPGGSLRLS<br>CAASGRTFTTHAMGWFRQAPGKEREFVSAINWGGRTTYYADSVKGRFIISR<br>DIGANTLYLQMNSLRAEDTAVYYCASNLDTYNVRAGTINSWGQGTQVTVSS |

TABLE 17-continued

| Multi-specific Molecules | |
|---|---|
| | GGGGSGGGSQVQLVESGGGLVQAGGSLRLSCAASGGGRTFSNYALGWFRQA<br>PGKEREFVAAISRSGGNINYADSVKGRFTISRDNFKNTTYLQMSSLEPEDT<br>AVYYCAAHYLLLPSYISTSTNMYNYWGQGTQVTVSSGGGGSGGGSEVQLVE<br>SGGGLVQPGGSLRLSCAASGGTFLTYSMSWVRQAPGKEREFVSSINWSGYM<br>TYYADSVKGRFTISRDNSKNTLYLQMNSLRAEDTAVYYCAAARTAIAAKRS<br>SEFDYWGQGTQVTVSS |
| hHS5-L11*9-CD16F1-<br>L1-A09-10-L3-A0910-<br>L1-hPL16-L3-hPL16<br>(SEQ ID NO: 171) | EVQLLESGGGLVQPGGSLRLSCAASGRTFTTHAMGWFRQAPGKEREFVSAI<br>NWGGRTTYYADSVKGRFIISRDTGANTLYLQMNSLRAEDTAVYYCASNLDT<br>YNVRAGTTNSWGQGTQVTVSSGGSGRSAPLGLARQARQVGGSEVQLVESGG<br>GLVQPGGSLRLSCAVSGSLFSARVMGWYRQAPGKQRELVAAITSGVRTDYA<br>DSVKGRFTISRDNAKRAVYLQMNSLKPEDTAVYYCNVNLYNTGNYWGQGTQ<br>VTVSSGGGGSGGGSEVQLVESGGGLVQAGGSLRLSCAASGGGRTFSNYALG<br>WFRQAPGKEREFVAAISRSGGNINYADSAKGRFTISRDNFKNTTYLQMSSL<br>KPEDTAVYYCAAHYLLLPSYISTSTNMYNYWGQGTQVTVSSAAAQVQLVES<br>GGGLVQAGGSLRLSCAASGGGRTFSNYALGWFRQAPGKEREFVAAISRSGG<br>NINYADSAKGRFTISRDNFKNTTYLQMSSLKPEDTAVYYCAAHYLLLPSYI<br>STSTNMYNYWGQGTQVTVSSGGGGSGGGSEVQLVESGGGLVQPGGSLRLSC<br>AASGGTFLTYSMSWVRQAPGKEREFVSSINWSGYMTYYADSVKGRFTISRD<br>NSKNTLYLQMNSLRAEDTAVYYCAAARTAIAAKRSSEFDYWGQGTQVTVSS<br>GGGGSGGGSEVQLVESGGGLVQPGGSLRLSCAASGGTFLTYSMSWVRQAPG<br>KEREFVSSINWSGYMTYYADSVKGRFTISRDNSKNTLYLQMNSLRAEDTAV<br>YYCAAARTAIAAKRSSEFDYWGQGTQVTVSS |
| CD16F1-L1-hHS5-L1-<br>A09-10-L3-A09-10-L1-<br>hPL16-L3-hPL16<br>(1511-HS5)<br>(SEQ ID NO: 172) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTINSWGQGTQVTVSSGGGGSGG<br>GSEVQLVESGGGLVQAGGSLRLSCAASGGGRTFSNYALGWFRQAPGKEREF<br>VAAISRSGGNINYADSAKGRFTISRDNFKNTTYLQMSSLKPEDTAVYYCAA<br>HYLLLPSYISTSTNMYNYWGQGTQVTVSSAAAQVQLVESGGGLVQAGGSLR<br>LSCAASGGGRTFSNYALGWFRQAPGKEREFVAAISRSGGNINYADSAKGRF<br>TISRDNFKNTTYLQMSSLKPEDTAVYYCAAHYLLLPSYISTSTNMYNYWGQ<br>GTQVTVSSGGGGSGGGSEVQLVESGGGLVQPGGSLRLSCAASGGTFLTYSM<br>SWVRQAPGKEREFVSSINWSGYMTYYADSVKGRFTISRDNSKNTLYLQMNS<br>LRAEDTAVYYCAAARTAIAAKRSSEFDYWGQGTQVTVSSAAAEVQLVESGG<br>GLVQPGGSLRLSCAASGGTFLTYSMSWVRQAPGKEREFVSSINWSGYMTYY<br>ADSVKGRFTISRDNSKNTLYLQMNSLRAEDTAVYYCAAARTAIAAKRSSEF<br>DYWGQGTQVTVSS |
| CD16F1-L1-hHS5-L1-<br>hA09-10-3-L3-hA09-<br>10-4-L1-hPL16-L3-<br>hPL16<br>(1518-HS5)<br>(SEQ ID NO: 173) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTINSWGQGTQVTVSSGGGGSGG<br>GSEVQLVESGGGLVQPGGSLRLSCAASGGGRTFSNYALGWFRQAPGKEREF<br>VAAISRSGGNINYADSVKGRFTISRDNAKNTVYLQMSSLRAEDTAVYYCAA<br>HYLLLPSYISTSTNMYNYWGQGTQVTVSSAAAQVQLVESGGGLVQPGGSLR<br>LSCAASGGGRTFSNYALGWFRQAPGKEREFVAAISRSGGNINYADSVKGRF<br>TISRDNAKNTVYLQMSSLRAEDTAVYYCAAHYLLLPSYISTSTNMYNYWGQ<br>GTQVTVSSGGGGSGGGSEVQLVESGGGLVQPGGSLRLSCAASGGTFLTYSM<br>SWVRQAPGKEREFVSSINWSGYMTYYADSVKGRFTISRDNSKNTLYLQMNS<br>LRAEDTAVYYCAAARTAIAAKRSSEFDYWGQGTQVTVSSAAAEVQLVESGG<br>GLVQPGGSLRLSCAASGGTFLTYSMSWVRQAPGKEREFVSSINWSGYMTYY<br>ADSVKGRFTISRDNSKNTLYLQMNSLRAEDTAVYYCAAARTAIAAKRSSEF<br>DYWGQGTQVTVSS |
| hHS5-L11*9-CD16F1-<br>L1-hA09-10-2-L3-A09-<br>10-L1- H33-14-L3-H33-<br>14<br>(SEQ ID NO: 174) | EVQLLESGGGLVQPGGSLRLSCAASGRTFTTHAMGWFRQAPGKEREFVSAI<br>NWGGRTTYYADSVKGRFIISRDTGANTLYLQMNSLRAEDTAVYYCASNLDT<br>YNVRAGTTNSWGQGTQVTVSSGGSGRSAPLGLARQARQVGGSEVQLVESGG<br>GLVQPGGSLRLSCAVSGSLFSARVMGWYRQAPGKQRELVAAITSGVRTDYA<br>DSVKGRFTISRDNAKRAVYLQMNSLKPEDTAVYYCNVNLYNTGNYWGQGTQ<br>VTVSSGGGGSGGGSEVQLVESGGGLVQPGGSLRLSCAASGGGRTFSNYALG<br>WFRQAPGKEREFVAAISRSGGNINYADSVKGRFTISRDNFKNTTYLQMSSL<br>EPEDTAVYYCAAHYLLLPSYISTSTNMYNYWGQGTQVTVSSAAAQVQLVES<br>GGGLVQAGGSLRLSCAASGGGRTFSNYALGWFRQAPGKEREFVAAISRSGG<br>NINYADSVKGRFTISRDNFKNTTYLQMSSLEPEDTAVYYCAAHYLLLPSYI<br>STSTNMYNYWGQGTQVTVSSGGGGSGGGSQVQLVESGGGLVQPGGSLRLSC<br>AASGRTSLILAMAWWRQAPGKEREFAGRIWWNNDMTRYSDSVKGRFTISRD<br>NAKNTVYLQMSSLRAEDTAVYYCEADLIGGSRGWGQGTLVTVSSAAAQVQL<br>VESGGGLVQPGGSLRLSCAASGRTSLILAMAWWRQAPGKEREFAGRIWWNN<br>DMTRYSDSVKGRFTISRDNAKNTVYLQMSSLRAEDTAVYYCEADLIGGSRG<br>WGQGTLVTVSS |
| CD16F1-L1-hHS5-L1-<br>hA09-10-3-L3-hA09-<br>10-4-L1-H33-14-L3- | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT |

TABLE 17-continued

| Multi-specific Molecules | |
|---|---|
| H33-14<br>(3211-HS5)<br>(SEQ ID NO: 175) | FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GSEVQLVESGGGLVQPGGSLRLSCAASGGGRTFSNYALGWFRQAPGKEREF<br>VAAISRSGGNINYADSVKGRFTISRDNFKNTVYLQMSSLRAEDTAVYYCAA<br>HYLLLPSYISTSTNMYNYWGQGTQVTVSSAAAQVQLVESGGGLVQPGGSLR<br>LSCAASGGGRTFSNYALGWFRQAPGKEREFVAAISRSGGNINYADSVKGRF<br>TISRDNAKNTVYLQMSSLRAEDTAVYYCAAHYLLLPSYISTSTNMYNYWGQ<br>GTQVTVSSGGGGSGGGSQVQLVESGGGLVQPGGSLRLSCAASGRTSLILAM<br>AWWRQAPGKEREFAGRIWWNNDMTRYSDSVKGRFTISRDNAKNTVYLQMSS<br>LRAEDTAVYYCEADLIGGSRGWGQGTLVTVSSAAAQVQLVESGGGLVQPGG<br>SLRLSCAASGRTSLILAMAWWRQAPGKEREFAGRIWWNNDMTRYSDSVKGR<br>FTISRDNAKNTVYLQMSSLRAEDTAVYYCEADLIGGSRGWGQGTLVTVSS |
| hHS5-L11*9-CD16F1-<br>L3-CD16F1-L1-hA09-<br>10-2-L3-A09-10-L1-<br>hPL-16-L3-hPL-16<br>(SEQ ID NO: 176) | EVQLLESGGGLVQPGGSLRLSCAASGRTFTTHAMGWFRQAPGKEREFVSAI<br>NWGGRTTYYADSVKGRFIISRDTGANTLYLQMNSLRAEDTAVYYCASNLDT<br>YNVRAGTTNSWGQGTQVTVSSGGSGRSAPLGLARQARQVGGSEVQLVESGG<br>GLVQPGGSLRLSCAVSGSLFSARVMGWYRQAPGKQRELVAAITSGVRTDYA<br>DSVKGRFTISRDNAKRAVYLQMNSLKPEDTAVYYCNVNLYNTGNYWGQGTQ<br>VTVSSAAAEVQLVESGGGLVQPGGSLRLSCAVSGSLFSARVMGWYRQAPGK<br>QRELVAAITSGVRTDYADSVKGRFTISRDNAKRAVYLQMNSLKPEDTAVYY<br>CNVNLYNTGNYWGQGTQVTVSSGGGGSGGGSEVQLVESGGGLVQPGGSLRL<br>SCAASGGGRTFSNYALGWFRQAPGKEREFVAAISRSGGNINYADSVKGRFT<br>ISRDNFKNTTYLQMSSLEPEDTAVYYCAAHYLLLPSYISTSTNMYNYWGQG<br>TQVTVSSAAAQVQLVESGGGLVQAGGSLRLSCAASGGGRTFSNYALGWFRQ<br>APGKEREFVAAISRSGGNINYADSVKGRFTISRDNFKNTTYLQMSSLEPED<br>TAVYYCAAHYLLLPSYISTSTNMYNYWGQGTQVTVSSGGGGSGGGSEVQLV<br>ESGGGLVQPGGSLRLSCAASGGTFLTYSMSWVRQAPGKEREFVSSINWSGY<br>MTYYADSVKGRFTISRDNSKNTLYLQMNSLRAEDTAVYYCAAARTAIAAKR<br>SSEFDYWGQGTQVTVSSAAAEVQLVESGGGLVQPGGSLRLSCAASGGTFLT<br>YSMSWVRQAPGKEREFVSSINWSGYMTYYADSVKGRFTISRDNSKNTLYLQ<br>MNSLRAEDTAVYYCAAARTAIAAKRSSEFDYWGQGTQVTVSS |
| CD16F1-L3-CD16F1-<br>L1-hHS5-L1- hA09-10-<br>2-L3-A09-10-L1-H33-<br>14-L3-H33-14<br>(SEQ ID NO: 177) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSAAAEVQLVESGGGLVQPGGSLRLSCAVSGSLFSARVM<br>GWYRQAPGKQRELVAAITSGVRTDYADSVKGRFTISRDNAKRAVYLQMNSL<br>KPEDTAVYYCNVNLYNTGNYWGQGTQVTVSSGGGGSGGGSEVQLLESGGGL<br>VQPGGSLRLSCAASGRTFTTHAMGWFRQAPGKEREFVSAINWGGRTTYYAD<br>SVKGRFIISRDTGANTLYLQMNSLRAEDTAVYYCASNLDTYNVRAGTTNSW<br>GQGTQVTVSSGGGGSGGGSEVQLVESGGGLVQPGGSLRLSCAASGGGRTFS<br>NYALGWFRQAPGKEREFVAAISRSGGNINYADSVKGRFTISRDNFKNTTYL<br>QMSSLEPEDTAVYYCAAHYLLLPSYISTSTNMYNYWGQGTQVTVSSAAAQV<br>QLVESGGGLVQAGGSLRLSCAASGGGRTFSNYALGWFRQAPGKEREFVAAI<br>SRSGGNINYADSVKGRFTISRDNFKNTTYLQMSSLEPEDTAVYYCAAHYLL<br>LPSYISTSTNMYNYWGQGTQVTVSSGGGGSGGGSQVQLVESGGGLVQPGGS<br>LRLSCAASGRTSLILAMAWWRQAPGKEREFAGRIWWNNDMTRYSDSVKGRF<br>TISRDNAKNTVYLQMSSLRAEDTAVYYCEADLIGGSRGWGQGTLVTVSSAA<br>AQVQLVESGGGLVQPGGSLRLSCAASGRTSLILAMAWWRQAPGKEREFAGR<br>IWWNNDMTRYSDSVKGRFTISRDNAKNTVYLQMSSLRAEDTAVYYCEADLI<br>GGSRGWGQGTLVTVSS |
| hHS5-L11*9-CD16F1-<br>L3-CD16F1-L1- hA09-<br>10-2-L3-A09-10-L1-<br>H33-14-L3-H33-14<br>(SEQ ID NO: 178) | EVQLLESGGGLVQPGGSLRLSCAASGRTFTTHAMGWFRQAPGKEREFVSAI<br>NWGGRTTYYADSVKGRFIISRDTGANTLYLQMNSLRAEDTAVYYCASNLDT<br>YNVRAGTTNSWGQGTQVTVSSGGSGRSAPLGLARQARQVGGSEVQLVESGG<br>GLVQPGGSLRLSCAVSGSLFSARVMGWYRQAPGKQRELVAAITSGVRTDYA<br>DSVKGRFTISRDNAKRAVYLQMNSLKPEDTAVYYCNVNLYNTGNYWGQGTQ<br>VTVSSAAAEVQLVESGGGLVQPGGSLRLSCAVSGSLFSARVMGWYRQAPGK<br>QRELVAAITSGVRTDYADSVKGRFTISRDNAKRAVYLQMNSLKPEDTAVYY<br>CNVNLYNTGNYWGQGTQVTVSSGGGGSGGGSEVQLVESGGGLVQPGGSLRL<br>SCAASGGGRTFSNYALGWFRQAPGKEREFVAAISRSGGNINYADSVKGRFT<br>ISRDNFKNTTYLQMSSLEPEDTAVYYCAAHYLLLPSYISTSINMYNYWGQG<br>TQVTVSSAAAQVQLVESGGGLVQAGGSLRLSCAASGGGRTFSNYALGWFRQ<br>APGKEREFVAAISRSGGNINYADSVKGRFTISRDNFKNTTYLQMSSLEPED<br>TAVYYCAAHYLLLPSYISTSTNMYNYWGQGTQVTVSSGGGGSGGGSQVQLV<br>ESGGGLVQPGGSLRLSCAASGRTSLILAMAWWRQAPGKEREFAGRIWWNND<br>MTRYSDSVKGRFTISRDNAKNTVYLQMSSLRAEDTAVYYCEADLIGGSRGW<br>GQGTLVTVSSAAAQVQLVESGGGLVQPGGSLRLSCAASGRTSLILAMAWWR<br>QAPGKEREFAGRIWWNNDMTRYSDSVKGRFTISRDNAKNTVYLQMSSLRAE<br>DTAVYYCEADLIGGSRGWGQGTLVTVSS |
| H33-14-L3-H33-14-L1-<br>hA09-10-2-L3-A09-10-<br>L1-hHS5-L1-CD16F1<br>(SEQ ID NO: 179) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT |

TABLE 17-continued

| Multi-specific Molecules | |
|---|---|
| | FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG<br>GSGGGSEVQLLESGGGLVQPGGSLRLSCAASGRTFTTHAMGWFRQAPGKER<br>EFVSAINWGGRTTYYADSVKGRFIISRDTGANTLYLQMNSLRAEDTAVYYC<br>ASNLDTYNVRAGTTNSWGQGTQVTVSSGGGGSGGGSEVQLVESGGGLVQPG<br>GSLRLSCAVSGSLFSARVMGWYRQAPGKQRELVAAITSGVRTDYADSVKGR<br>FTISRDNAKRAVYLQMNSLKPEDTAVYYCNVNLYNTGNYWGQGTQVTVSS |
| H33-14-L3-H33-14-L1-<br>hA09-10-2-L3-A09-10-<br>L1-hHS5-L1-CD16F1-<br>L3-CD16F1<br>(SEQ ID NO: 180) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG<br>GSGGGSEVQLLESGGGLVQPGGSLRLSCAASGRIFTTHAMGWFRQAPGKER<br>EFVSAINWGGRTTYYADSVKGRFIISRDTGANTLYLQMNSLRAEDTAVYYC<br>ASNLDTYNVRAGTTNSWGQGTQVTVSSGGGGSGGGSEVQLVESGGGLVQPG<br>GSLRLSCAVSGSLFSARVMGWYRQAPGKQRELVAAITSGVRTDYADSVKGR<br>FTISRDNAKRAVYLQMNSLKPEDTAVYYCNVNLYNTGNYWGQGTQVTVSSA<br>AAEVQLVESGGGLVQPGGSLRLSCAVSGSLFSARVMGWYRQAPGKQRELVA<br>AITSGVRTDYADSVKGRFTISRDNAKRAVYLQMNSLKPEDTAVYYCNVNLY<br>NTGNYWGQGTQVTVSS |
| H33-14-L3-H33-14-L1-<br>hA09-10-2-L3-A09-10-<br>L1-CD16F1-L11*9-<br>hHS5<br>(SEQ ID NO: 181) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG<br>GSGGGSEVQLVESGGGLVQPGGSLRLSCAVSGSLFSARVMGWYRQAPGKQR<br>ELVAAITSGVRTDYADSVKGRFTISRDNAKRAVYLQMNSLKPEDTAVYYCN<br>VNLYNTGNYWGQGTQVTVSSGGSGRSAPLGLARQARQVGGSEVQLLESGGG<br>LVQPGGSLRLSCAASGRTFTTHAMGWFRQAPGKEREFVSAINWGGRTTYYA<br>DSVKGRFIISRDTGANTLYLQMNSLRAEDTAVYYCASNLDTYNVRAGTINS<br>WGQGTQVTVSS |
| H33-14-L3-H33-14- L1-<br>hA09-10-2-L3-A09-10-<br>L1-CD16-F1-L3-<br>CD16F1-L11*9-hHS5<br>(SEQ ID NO: 182) | QVQLVESGGGLVQPGGSLRLSCAASGRTSLILAMAWWRQAPGKEREFAGRI<br>WWNNDMTRYSDSVKGRFTISRDNAKNTVYLQMSSLRAEDTAVYYCEADLIG<br>GSRGWGQGTLVTVSSAAAQVQLVESGGGLVQPGGSLRLSCAASGRTSLILA<br>MAWWRQAPGKEREFAGRIWWNNDMTRYSDSVKGRFTISRDNAKNTVYLQMS<br>SLRAEDTAVYYCEADLIGGSRGWGQGTLVTVSSGGGGSGGGSEVQLVESGG<br>GLVQPGGSLRLSCAASGGGRTFSNYALGWFRQAPGKEREFVAAISRSGGNI<br>NYADSVKGRFTISRDNFKNTTYLQMSSLEPEDTAVYYCAAHYLLLPSYIST<br>STNMYNYWGQGTQVTVSSAAAQVQLVESGGGLVQAGGSLRLSCAASGGGRT<br>FSNYALGWFRQAPGKEREFVAAISRSGGNINYADSVKGRFTISRDNFKNTT<br>YLQMSSLEPEDTAVYYCAAHYLLLPSYISTSTNMYNYWGQGTQVTVSSGGG<br>GSGGGSEVQLVESGGGLVQPGGSLRLSCAVSGSLFSARVMGWYRQAPGKQR<br>ELVAAITSGVRTDYADSVKGRFTISRDNAKRAVYLQMNSLKPEDTAVYYCN<br>VNLYNTGNYWGQGTQVTVSSAAAEVQLVESGGGLVQPGGSLRLSCAVSGSL<br>FSARVMGWYRQAPGKQRELVAAITSGVRTDYADSVKGRFTISRDNAKRAVY<br>LQMNSLKPEDTAVYYCNVNLYNTGNYWGQGTQVTVSSGGSGRSAPLGLARQ<br>ARQVGGSEVQLLESGGGLVQPGGSLRLSCAASGRTFTTHAMGWFRQAPGKE<br>REFVSAINWGGRTTYYADSVKGRFIISRDTGANTLYLQMNSLRAEDTAVYY<br>CASNLDTYNVRAGTTNSWGQGTQVTVSS |
| CD16F1-L1-hHS5-L4-<br>hA09-10-3-L3-hA09-<br>10-4-L1-H33-14-L3-<br>H33-14<br>(3321-HS5-GS15)<br>(SEQ ID NO: 183) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVAAISRSGGNINYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVAAISRSGGNINYAD<br>SVKGRFTISRDNAKNTVYLQMSSLRAEDTAVYYCAAHYLLLPSYISTSTNM |

TABLE 17-continued

| Multi-specific Molecules | |
|---|---|
| | YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTLVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTL<br>VTVSS |
| CD16F1-L1-hHS5-L1-<br>hA09-10-3-L3-hA09-<br>10-4-L1-hPL16-L3-<br>hPL16<br>(1518-HS5-GS15)<br>(SEQ ID NO: 184) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVAAISRSGGNINYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVAAISRSGGNINYAD<br>SVKGRFTISRDNAKNTVYLQMSSLRAEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-1-L1-hHS5-<br>L4-hA09-10-45- L1-<br>hPL16-L3-hPL-16<br>(SEQ ID NO: 185) | EVQLVESGGGLVQPGGSLRLSCAASGSLFSARVMGWYRQAPGKQRELVSAI<br>TSGVRTYYADSVKGRFTISRDNAKRAVYLQMSSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRITYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNFKNTVYLQMSSLRAEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNFKNTTYLQMSSLRAEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-2-L1-hHS5-<br>L4-hA09-10-45- L1-<br>hPL16-L3-hPL-16<br>(SEQ ID NO: 186) | EVQLVESGGGLVQPGGSLRLSCAASGSLFSARVMGWYRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNFKNTVYLQMSSLRAEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNFKNTTYLQMSSLRAEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-1-L1-hHS5-<br>L4-hA09-10-55-L1-<br>hPL16-L3-hPL16<br>(SEQ ID NO: 187) | EVQLVESGGGLVQPGGSLRLSCAVSGSLFSARVMSWVRQAPGKQRELVSAI<br>TSGVRTYYADSVKGRFTISRDNAKRAVYLQMSSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNSKNTLYLQMSSLEPEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNSKNTLYLQMSSLEPEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |

TABLE 17-continued

| Multi-specific Molecules | |
|---|---|
| hCD16F1-2-L1-hHS5-<br>L4-hA09-10-55-L1-<br>hPL16-L3-hPI-16<br>(SEQ ID NO: 188) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNSKNTLYLQMSSLEPEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNSKNTLYLQMSSLEPEDTAVYYCAAHYLLLPSYISTSTNM<br>YNYWGQGTQVTVSSGGGGSGGGSEVQLVESGGGLVQPGGSLRISCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-1-L1-hHS5-<br>L4-hA09-10-66- L1-<br>hPL16-L3-hPL-16<br>(SEQ ID NO: 189) | EVQLVESGGGLVQPGGSLRLSCAVSGSLFSARVMSWVRQAPGKQRELVSAI<br>TSGVRTYYADSVKGRFTISRDNAKRAVYLQMSSLKPEDTAVYYCNVNLYNT<br>GNYWGQGTQVTVSSGGGGSGGGSEVQLLESGGGLVQPGGSLRISCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNAKNTVYLQMSSLRAEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-2-L1-hHS5-<br>L4-hA09-10-66- L1-<br>hPL16-L3-hPL-16<br>(SEQ ID NO: 190) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTI<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNAKNTVYLQMSSLRAEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-1-L1-hHS5-<br>L4-hA09-10-77- L1-<br>hPL16-L3-hPL-16<br>(SEQ ID NO: 191) | EVQLVESGGGLVQPGGSLRLSCAVSGSLFSARVMSWVRQAPGKQRELVSAI<br>TSGVRTYYADSVKGRFTISRDNAKRAVYLQMSSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIDYAD<br>SVKGRFTISRDNSKNTLYLQMSSLKPEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-2-L1-hHS5-<br>L4-hA09-10-77- L1-<br>hPL16-L3-hPL-16<br>(SEQ ID NO: 192) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIDYAD<br>SVKGRFTISRDNSKNTLYLQMSSLKPEDTAVYYCAAHYLLLPSYISTSTNM |

TABLE 17-continued

| Multi-specific Molecules | |
|---|---|
| | YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-1-L1-hHS5-L4-hA09-10-88- L1-hPL16-L3-hPL-16 (SEQ ID NO: 193) | EVQLVESGGGLVQPGGSLRLSCAVSGSLFSARVMSWVRQAPGKQRELVSAI<br>TSGVRTYYADSVKGRFTISRDNAKRAVYLQMNSLKPEDTAVYYCNVNLYNT<br>GNYWGQGTQVTVSSGGGGSGGGSEVQLLESGGGLVQPGGSLRISCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-2-L1-hHS5-L4-hA09-10-88- L1-hPL16-L3-hPL-16 (SEQ ID NO: 194) | EVQLVESGGGLVQPGGSLRLSCAVSGSLFSARVMSWVRQAPGKQRELVSAI<br>TSGVRTYYADSVKGRFTISRDNAKRAVYLQMNSLRAEDTAVYYCNVNLYNT<br>GNYWGQGTQVTVSSGGGGSGGGSEVQLLESGGGLVQPGGSLRISCAASGRT<br>FTTHAMGWFRQAPGKEREFVSAINWGGRITYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-1-L1-hHS5-L4-hA09-10-99- L1-hPL16-L3-hPL-16 (SEQ ID NO: 195) | EVQLVESGGGLVQPGGSLRLSCAVSGSLFSARVMSWVRQAPGKQRELVSAI<br>TSGVRTYYADSVKGRFTISRDNAKRAVYLQMNSLEPEDTAVYYCNVNLYNT<br>GNYWGQGTQVTVSSGGGGSGGGSEVQLLESGGGLVQPGGSLRISCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYAMGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-2-L1-hHS5-L4-hA09-10-99- L1-hPL16-L3-hPL-16 (SEQ ID NO: 196) | EVQLVESGGGLVQPGGSLRLSCAVSGSLFSARVMSWVRQAPGKQRELVSAI<br>TSGVRTYYADSVKGRFTISRDNAKRAVYLQMNSLRAEDTAVYYCNVNLYNT<br>GNYWGQGTQVTVSSGGGGSGGGSEVQLLESGGGLVQPGGSLRISCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYAMGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |

TABLE 17-continued

| Multi-specific Molecules | |
|---|---|
| hCD16F1-1-L1-hHS5-L4-hA09-10-100- L1-hPL16-L3-hPL-16 (SEQ ID NO: 197) | EVQLVESGGGLVQPGGSLRLSCAVSGSLFSARVMSWVRQAPGKQRELVSAI<br>TSGVRTYYADSVKGRFTISRDNAKRAVYLQMNSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTINSWGQGTQVTVSSGGGGSGG<br>GGSGGGGSEVQLVESGGGLVQPGGSLRLSCAASGGGRTFSNYAMGWFRQAP<br>GKEREFVSAISRSGGNIYYADSVKGRFTISRDNSKNTLYLQMSSLRAEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLRAEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| hCD16F1-2-L1-hHS5-L4-hA09-10-100-L1-hPL16-L3-hPL-16 (SEQ ID NO: 198) | EVQLVESGGGLVQPGGSLRLSCAVSGSLFSARVMSWVRQAPGKQRELVSAI<br>TSGVRTYYADSVKGRFTISRDNAKRAVYLQMNSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYAMGWFRQAP<br>GKEREFVSAISRSGGNIYYADSVKGRFTISRDNSKNTLYLQMSSLRAEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLRAEDTAVYYCAAHYLLLPSYISTSTNM<br>YNYWGQGTQVTVSSGGGGSGGGSEVQLVESGGGLVQPGGSLRLSCAASGGT<br>FLTYSMSWVRQAPGKEREFVSSINWSGYMTYYADSVKGRFTISRDNSKNTL<br>YLQMNSLRAEDTAVYYCAAARTAIAAKRSSEFDYWGQGTQVTVSSAAAEVQ<br>LVESGGGLVQPGGSLRLSCAASGGTFLTYSMSWVRQAPGKEREFVSSINWS<br>GYMTYYADSVKGRFTISRDNSKNTLYLQMNSLRAEDTAVYYCAAARTAIAA<br>KRSSEFDYWGQGTQVTVSS |
| CD16F1-L1-hHS5-L4-hA09-10-L3-hA09-10-L1-H33-14-L3-H33-14 (3321-HS5-GS15) (SEQ ID NO: 199) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYALGWFRQAP<br>GKEREFVAAISRSGGNINYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVAAISRSGGNINYAD<br>SVKGRFTISRDNAKNTVYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTLVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTL<br>VTVSS |
| hCD16F1-1-L1-hHS5-L4-hA09-10-3-L3-hA09-10-4-L1-H33-14-L3-H33-14 (SEQ ID NO: 200) | EVQLVESGGGLVQPGGSLRLSCAVSGSLFSARVMSWVRQAPGKQRELVSAI<br>TSGVRTYYADSVKGRFTISRDNAKRAVYLQMSSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTINSWGQGTQVTVSSGGGGSGG<br>GGSGGGGSEVQLVESGGGVVRPGGSLRLSCAASGGGRTFSNYALGWFRQAP<br>GKEREFVAAISRSGGNINYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVAAISRSGGNINYAD<br>SVKGRFTISRDNAKNTVYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTLVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTL<br>VTVSS |
| hCD16F1-2-L1-hHS5-L4-hA09-10-3-L3-hA09-10-4-L1-H33-14-L3-H33-14 (SEQ ID NO: 201) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTINSWGQGTQVTVSSGGGGSGG<br>GGSGGGGSEVQLVESGGGLVQPGGSLRLSCAASGGGRTFSNYALGWFRQAP<br>GKEREFVAAISRSGGNINYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVAAISRSGGNINYAD<br>SVKGRFTISRDNAKNTVYLQMSSLRAEDTAVYYCAAHYLLLPSYISTSTNM |

TABLE 17-continued

| Multi-specific Molecules | |
|---|---|
| | YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTLVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTL<br>VTVSS |
| hCD16F1-1-L1-hHS5-<br>L4-hA09-10-45- L1-<br>H33-14-L3-H33-14<br>(SEQ ID NO: 202) | EVQLVESGGGLVQPGGSLRLSCAVSGSLFSARVMSWVRQAPGKQRELVSAI<br>TSGVRTYYADSVKGRFTISRDNAKRAVYLQMSSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNFKNTVYLQMSSLRAEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNAKNTVYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-2-L1-hHS5-<br>L4-hA09-10-45- L1-<br>H33-14-L3-H33-14<br>(SEQ ID NO: 203) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRITTYYADSVKGRFIISRDT-<br>GANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNFKNTVYLQMSSLRAEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNFKNTTYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-1-L1-hHS5-<br>L4-hA09-10-55-L1-<br>H33-14-L3-H33-14<br>(SEQ ID NO: 204) | EVQLVESGGGLVQPGGSLRLSCAVSGSLFSARVMSWVRQAPGKQRELVSAI<br>TSGVRTYYADSVKGRFTISRDNAKRAVYLQMSSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNSKNTLYLQMSSLEPEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNSKNTLYLQMSSLEPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-2-L1-hHS5-<br>L4-hA09-10-55- L1-<br>H33-14-L3-H33-14<br>(SEQ ID NO: 205) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGVVRPGGSLRLSCAASGGGRTFSNYAMGWFRQAP<br>GKEREFVSAISRSGGNIYYADSVKGRFTISRDNSKNTLYLQMSSLEPEDTA<br>VYYCAAHYLLLPSYISTSTNMYNYWGQGTQVTVSSAAAQVQLVESGGGVVR<br>PGGSLRLSCAASGGGRTFSNYAMGWFRQAPGKEREFVSAISRSGGNIYYAD<br>SVKGRFTISRDNSKNTLYLQMSSLEPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-1-L1-hHS5-<br>L4-hA09-10-77- L1- | EVQLVESGGGLVQPGGSLRLSCAVSGSLFSARVMSWVRQAPGKQRELVSAI<br>TSGVRTYYADSVKGRFTISRDNAKRAVYLQMSSLEPEDTAVYYCNVNLYNT |

TABLE 17-continued

| Multi-specific Molecules | |
|---|---|
| H33-14-L3-H33-14<br>(SEQ ID NO: 206) | GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIDYAD<br>SVKGRFTISRDNSKNTLYLQMSSLKPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-2-L1-hHS5-<br>L4-hA09-10-77- L1-<br>H33-14-L3-H33-14<br>(SEQ ID NO: 207) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIDYAD<br>SVKGRFTISRDNSKNTLYLQMSSLKPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-1-L1-hHS5-<br>L1-hA09-10-66-L1-<br>H33-14-L3-H33-14<br>(SEQ ID NO: 208) | EVQLVESGGGLVQPGGSLRLSCAVSGSLFSARVMSWVRQAPGKQRELVSAI<br>TSGVRTYYADSVKGRFTISRDNAKRAVYLQMSSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNAKNTVYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-2-L1-hHS5-<br>L4-hA09-10-66-L1-<br>H33-14-L3-H33-14<br>(SEQ ID NO: 209) | EVQLVESGGGLVQPGGSLRLSCAVSGSLFSARVMSWVRQAPGKQRELVSAI<br>TSGVRTYYADSVKGRFTISRDNAKRAVYLQMSSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRITYYADSVKGRFIISRDIGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIDYADSVKGRFTISRDNFKNTVYLQMSSLRAEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNAKNTVYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-1-L1-hHS5-<br>L4-hA09-10-88-L1-<br>H33-14-L3-H33-14<br>(SEQ ID NO: 210) | EVQLVESGGGLVQPGGSLRLSCAVSGSLFSARVMSWVRQAPGKQRELVSAI<br>TSGVRTYYADSVKGRFTISRDNAKRAVYLQMNSLKPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRITYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG |

TABLE 17-continued

| Multi-specific Molecules | |
|---|---|
| | LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-2-L1-hHS5-<br>L4-hA09-10-88-L1-<br>H33-14-L3-H33-14<br>(SEQ ID NO: 211) | EVQLVESGGGLVQPGGSLRLSCAVSGSLFSARVMSWVRQAPGKQRELVSAI<br>TSGVRTYYADSVKGRFTISRDNAKRAVYLQMNSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYALGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYALGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-1-L1-hHS5-<br>L4-hA09-10-99-L1-<br>H33-14-L3-H33-14<br>(SEQ ID NO: 212) | EVQLVESGGGLVQPGGSLRLSCAVSGSLFSARVMSWVRQAPGKQRELVSAI<br>TSGVRTYYADSVKGRFTISRDNAKRAVYLQMNSLEPEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYAMGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-2-L1-hHS5-<br>L4-hA09-10-99-L1-<br>H33-14-L3-H33-14<br>(SEQ ID NO: 213) | EVQLVESGGGLVQPGGSLRLSCAVSGSLFSARVMSWVRQAPGKQRELVSAI<br>TSGVRTYYADSVKGRFTISRDNAKRAVYLQMNSLRAEDTAVYYCNVNLYNT<br>GNYWGQGTQVTVSSGGGGSGGGSEVQLLESGGGLVQPGGSLRISCAASGRT<br>FTTHAMGWFRQAPGKEREFVSAINWGGRITTYYADSVKGRFIISRDT-<br>GANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYAMGWFRQAP<br>GKEREFVSAISRSGGNIYYADSVKGRFTISRDNSKNTLYLQMSSLKPEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLKPEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-1-L1-hHS5-<br>L4-hA09-10-100-L1-<br>H33-14-L3-H33-14<br>(SEQ ID NO: 214) | EVQLVESGGGLVQPGGSLRLSCAVSGSLFSARVMSWVRQAPGKQRELVSAI<br>TSGVRTYYADSVKGRFTISRDNAKRAVYLQMNSLEPEDTAVYYCNVNLYNT<br>GNYWGQGTQVTVSSGGGGSGGGSEVQLLESGGGLVQPGGSLRISCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYAMGWFRQAP<br>GKEREFVSAISRSGGNIYYADSVKGRFTISRDNSKNTLYLQMSSLRAEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| hCD16F1-2-L1-hHS5-<br>L4-hA09-10-100-L1-<br>H33-14-L3-H33-14<br>(SEQ ID NO: 215) | EVQLVESGGGLVQPGGSLRLSCAVSGSLFSARVMSWVRQAPGKQRELVSAI<br>TSGVRTYYADSVKGRFTISRDNAKRAVYLQMNSLRAEDTAVYYCNVNLYNT<br>GNYWGQGTQVTVSSGGGGSGGGSEVQLLESGGGLVQPGGSLRLSCAASGRT<br>FTTHAMGWFRQAPGKEREFVSAINWGGRTTYYADSVKGRFIISRDTGANTL<br>YLQMNSLRAEDTAVYYCASNLDTYNVRAGTTNSWGQGTQVTVSSGGGGSGG<br>GGSGGGGSEVQLVESGGGLVQPGGSLRLSCAASGGGRTFSNYAMGWFRQAP |

TABLE 17-continued

| Multi-specific Molecules | |
|---|---|
| | GKEREFVSAISRSGGNIYYADSVKGRFTISRDNSKNTLYLQMSSLRAEDTA<br>VYYCAAHYLLLPSYISTSTNMYNYWGQGTQVTVSSAAAQVQLVESGGGLVQ<br>PGGSLRLSCAASGGGRTFSNYAMGWFRQAPGKEREFVSAISRSGGNIYYAD<br>SVKGRFTISRDNSKNTLYLQMSSLRAEDTAVYYCAAHYLLLPSYISTSTNM<br>YNYWGQGTQVTVSSGGGGSGGGSQVQLVESGGGLVQPGGSLRLSCAASGRT<br>SLILAMAWWRQAPGKEREFAGRIWWNNDMTRYSDSVKGRFTISRDNAKNTV<br>YLQMSSLRAEDTAVYYCEADLIGGSRGWGQGTQVTVSSAAAQVQLVESGGG<br>LVQPGGSLRLSCAASGRTSLILAMAWWRQAPGKEREFAGRIWWNNDMTRYS<br>DSVKGRFTISRDNAKNTVYLQMSSLRAEDTAVYYCEADLIGGSRGWGQGTQ<br>VTVSS |
| CD16F1-L1-hHS10-L4-<br>hA09-10-3-L3-hA09-<br>10-4-L1-H33-14-L3-<br>H33-14<br>(3321-GS15)<br>(SEQ ID NO: 216) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLVESGGGLVQPGGSLRLSCAASGST<br>DSAYRMGWFRQAPGKEREFVSAINWSDGRTYYADSVKGRFTISRDNSKNTL<br>YLQMNSLRAEDTAVYYCAADPDSRLYYTVPQNYDYWGQGTLVTVSSGGGGS<br>GGGGSGGGGSEVQLVESGGGLVQPGGSLRLSCAASGGGRTFSNYALGWFRQ<br>APGKEREFVAAISRSGGNINYADSVKGRFTISRDNFKNTVYLQMSSLRAED<br>TAVYYCAAHYLLLPSYISTSTNMYNYWGQGTQVTVSSAAAQVQLVESGGGL<br>VQPGGSLRLSCAASGGGRTFSNYALGWFRQAPGKEREFVAAISRSGGNINY<br>ADSVKGRFTISRDNAKNTVYLQMSSLRAEDTAVYYCAAHYLLLPSYISTST<br>NMYNYWGQGTQVTVSSGGGGSGGGSQVQLVESGGGLVQPGGSLRLSCAASG<br>RTSLILAMAWWRQAPGKEREFAGRIWWNNDMTRYSDSVKGRFTISRDNAKN<br>TVYLQMSSLRAEDTAVYYCEADLIGGSRGWGQGTLVTVSSAAAQVQLVESG<br>GGLVQPGGSLRLSCAASGRTSLILAMAWWRQAPGKEREFAGRIWWNNDMTR<br>YSDSVKGRFTISRDNAKNTVYLQMSSLRAEDTAVYYCEADLIGGSRGWGQG<br>TLVTVSS |
| CD16F1-L1-hHS10-L4-<br>hA09-10-3-L3-hA09-<br>10-4-L1-hPL16-L3-<br>hPL16<br>(1518-GS15)<br>(SEQ ID NO: 217) | EVQLVESGGGLVQPGGSLRLSCAVSGSLFSARVMGWYRQAPGKQRELVAAI<br>TSGVRTDYADSVKGRFTISRDNAKRAVYLQMNSLKPEDTAVYYCNVNLYNT<br>GNYWGQGTQVTVSSGGGGSGGGSEVQLVESGGGLVQPGGSLRLSCAASGST<br>DSAYRMGWFRQAPGKEREFVSAINWSDGRTYYADSVKGRFTISRDNSKNTL<br>YLQMNSLRAEDTAVYYCAADPDSRLYYTVPQNYDYWGQGTLVTVSSGGGGS<br>GGGGSGGGGSEVQLVESGGGLVQPGGSLRLSCAASGGGRTFSNYALGWFRQ<br>APGKEREFVAAISRSGGNINYADSVKGRFTISRDNFKNTVYLQMSSLRAED<br>TAVYYCAAHYLLLPSYISTSTNMYNYWGQGTQVTVSSAAAQVQLVESGGGL<br>VQPGGSLRLSCAASGGGRTFSNYALGWFRQAPGKEREFVAAISRSGGNINY<br>ADSVKGRFTISRDNAKNTVYLQMSSLRAEDTAVYYCAAHYLLLPSYISTST<br>NMYNYWGQGTQVTVSSGGGGSGGGSEVQLVESGGGLVQPGGSLRLSCAASG<br>GTFLTYSMSWVRQAPGKEREFVSSINWSGYMTYYADSVKGRFTISRDNSKN<br>TLYLQMNSLRAEDTAVYYCAAARTAIAAKRSSEFDYWGQGTQVTVSSAAAE<br>VQLVESGGGLVQPGGSLRLSCAASGGTFLTYSMSWVRQAPGKEREFVSSIN<br>WSGYMTYYADSVKGRFTISRDNSKNTLYLQMNSLRAEDTAVYYCAAARTAI<br>AAKRSSEFDYWGQGTQVTVSS |

Figure 17:
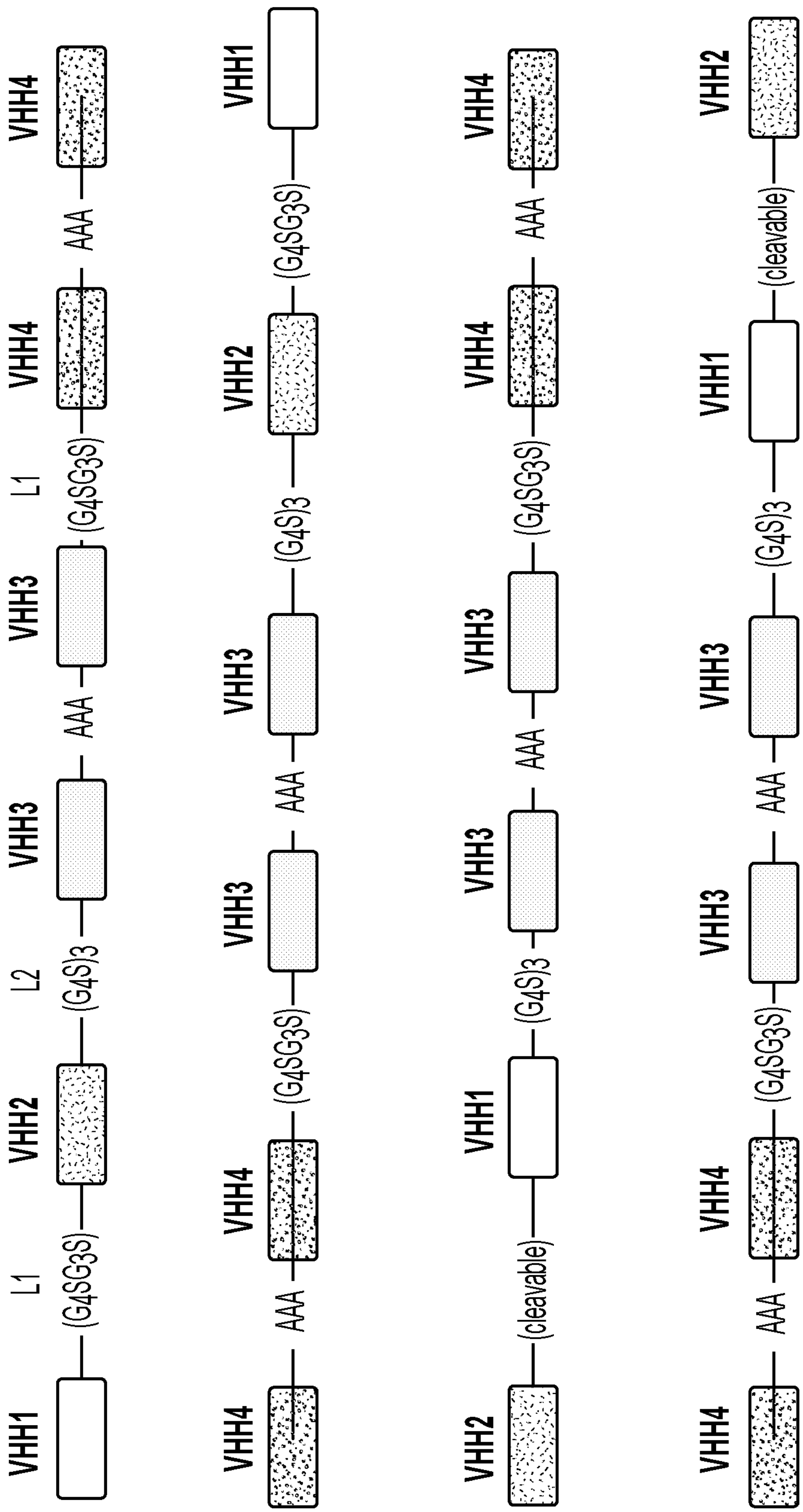
FIG. 17 depicts formats for quadbodies (four specificities). Two VHH3 could be the same VHH or different VHH against the same antigen binding to different epitope. Two VHH4 could be the same VHH or different VHH against the same antigen binding to different epitope. In some embodiments, VHH2 is always an HSA-binding domain. In some embodiments, VHH1 is payload such as CD16A agonist VHH.
Figure 18:
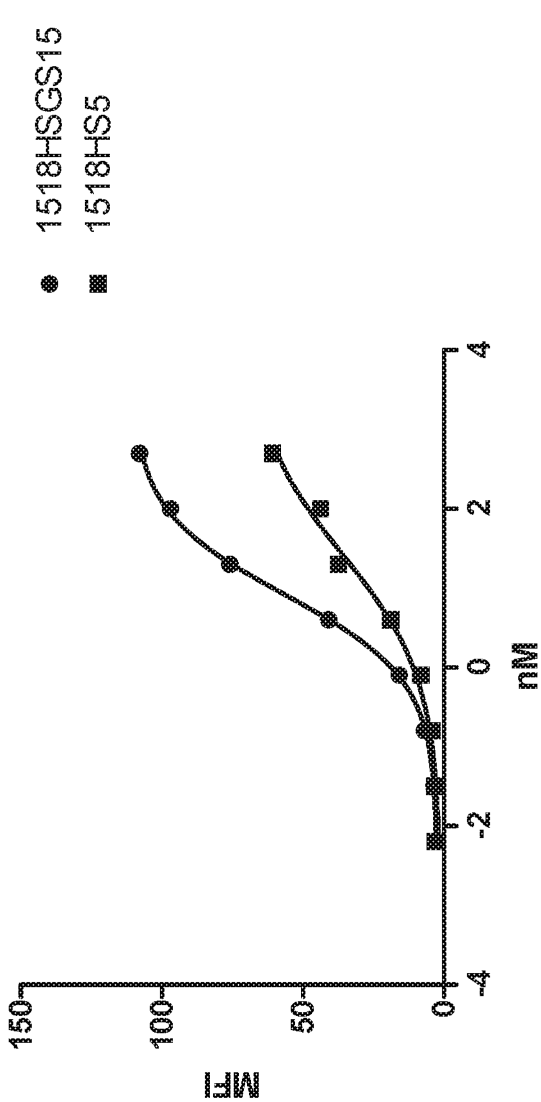
FIG. 18 depicts flow cytometric binding analysis of CD47-binding multi-specific molecules 1518-HS5 (SEQ ID NO:173) and 1518-HS5-GS15 (SEQ ID NO 184) on HL60 cell line.
Figure 19:
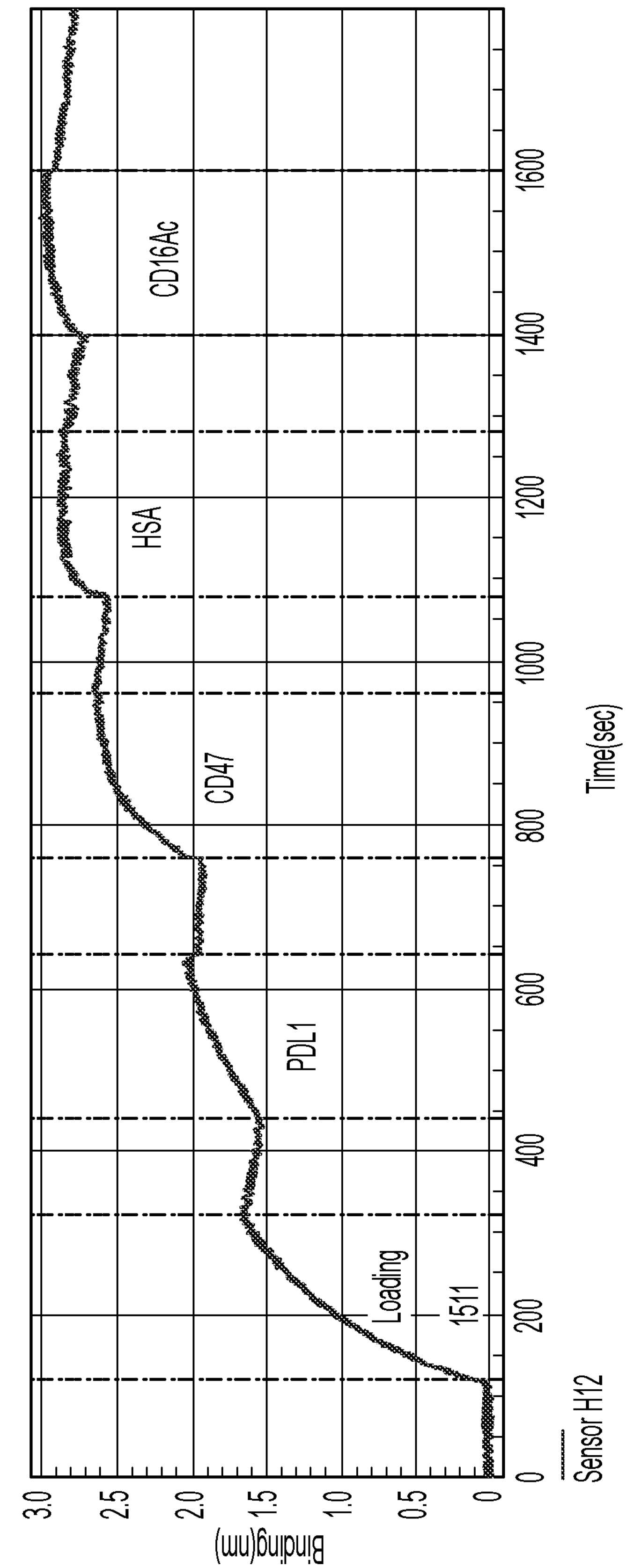
FIG. 19 depicts OCTET® binding analysis of multi-specific molecule 1511.
Figure 20:
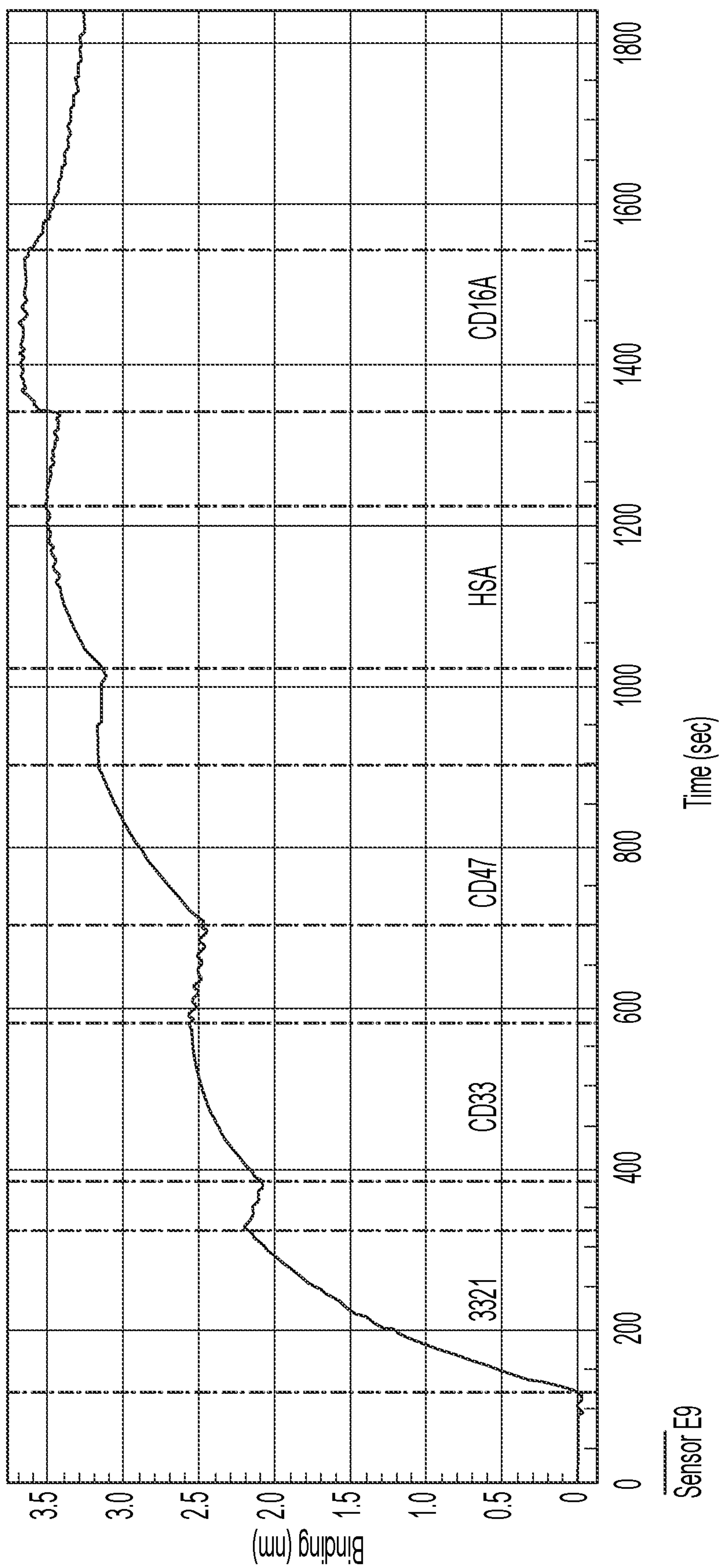
FIG. 20 depicts OCTET® binding analysis of multi-specific molecule 3321.

OCTET® binding analysis of the multi-specific molecule was conducted as in Example 8 and the results expressed in FIGS. 17 and 18.

Example 9. MVSCA Comprising Anti-CD33 Domains for Treatment of Alzheimer's Disease and Retinal Diseases

TABLE 18

| MVSCA Comprising anti-CD33 VHH* | |
|---|---|
| hHS5-L1-H33-14-L3-<br>H33-14 **<br>(SEQ ID NO: 218) | EVQLLESGGGLVQPGGSLRLSCAASGRTFTTHAMGWFRQAPGKER<br>EFVSAINWGGRTTYYADSVKGRFIISRDTGANTLYLQMNSLRAED<br>TAVYYCASNLDTYNVRAGTTNSWGQGTQVTVSSGGGGSGGGSQVQ<br>LVESGGGLVQPGGSLRLSCAASGRTSLILAMAWWRQAPGKEREFA<br>GRIWWNNDMTRYSDSVKGRFTISRDNAKNTVYLQMSSLRAEDTAV<br>YYCEADLIGGSRGWGQGTQVTVSSAAAQVQLVESGGGLVQPGGSL<br>RLSCAASGRTSLILAMAWWRQAPGKEREFAGRIWWNNDMTRYSDS<br>VKGRFTISRDNAKNTVYLQMSSLRAEDTAVYYCEADLIGGSRGWG<br>QGTQVTVSSHHHHHH |
| FC5-L1-H33-14-L3-<br>H33-14<br>(SEQ ID NO: 219) | EVQLQASGGGLVQAGGSLRLSCAASGFKITHYTMGWFRQAPGKER<br>EFVSRITWGGDNTFYSNSVKGRFTISRDNAKNTVYLQMNSLKPED<br>TADYYCAAGSTSTATPLRVDYWGKGTQVTVSSGGGGSGGGSQVQL<br>VESGGGLVQPGGSLRLSCAASGRTSLILAMAWWRQAPGKEREFAG<br>RIWWNNDMTRYSDSVKGRFTISRDNAKNTVYLQMSSLRAEDTAVY<br>YCEADLIGGSRGWGQGTQVTVSSAAAQVOLVESGGGLVQPGGSLR |

TABLE 18-continued

| MVSCA Comprising anti-CD33 VHH* | |
|---|---|
| | LSCAASGRTSLILAMAWWRQAPGKEREFAGRIWWNNDMTRYSDSV KGRFTISRDNAKNTVYLQMSSLRAEDTAVYYCEADLIGGSRGWGQ GTQVTVSS |
| FC5-L1-H33-14-L3-H33-14-L1-hHS5 (SEQ ID NO: 220) | EVQLQASGGGLVQAGGSLRLSCAASGFKITHYTMGWFRQAPGKER EFVSRITWGGDNTFYSNSVKGRFTISRDNAKNTVYLQMNSLKPED TADYYCAAGSTSTATPLRVDYWGKGTQVTVSSGGGGSGGGSQVQL VESGGGLVQPGGSLRLSCAASGRTSLILAMAWWRQAPGKEREFAG RIWWNNDMTRYSDSVKGRFTISRDNAKNTVYLQMSSLRAEDTAVY YCEADLIGGSRGWGQGTQVTVSSAAAQVOLVESGGGLVQPGGSLR LSCAASGRTSLILAMAWWRQAPGKEREFAGRIWWNNDMTRYSDSV KGRFTISRDNAKNTVYLQMSSLRAEDTAVYYCEADLIGGSRGWGQ GTQVTVSSGGGGSGGGSEVOLLESGGGLVQPGGSLRLSCAASGRT FTTHAMGWFRQAPGKEREFVSAINWGGRTTYYADSVKGRFIISRD TGANTLYLOMNSLRAEDTAVYYCASNLDTYNVRAGTTNSWGQGTQ VTVSS |
| H33-14-L3-H3314 (SEQ ID NO: 221) | QVQLVESGGGLVQPGGSLRLSCAASGRTSLILAMAWWRQAPGKER EFAGRIWWNNDMTRYSDSVKGRFTISRDNAKNTVYLQMSSLRAED TAVYYCEADLIGGSRGWGQGTQVTVSSAAAQVQLVESGGGLVQPG GSLRLSCAASGRTSLILAMAWWRQAPGKEREFAGRIWWNNDMTRY SDSVKGRFTISRDNAKNTVYLQMSSLRAEDTAVYYCEADLIGGSR GWGQGTQVTVSS |

*The linker sequences interposed between the VHH domains are underlined
** This sequence is shown with an optional C-terminal His-tag Each of the four MVSCA in Table 18 contain a pair of anti-CD33 domains joined by linker L3 (the sequence AAA; SEQ ID NO: 102). The first entry is in Table 18, hHS5-L1-H33-14-L3-H33-14, comprises an N-terminal anti-HSA domain to increase half-life in the body. The second entry in Table 18, FC5-L1-H33-14-L3-H33-14, comprises an N-terminal FC5 nanobody domain, to facilitate passing through the blood-brain barrier. The third entry in Table 18, FC5-L1-H33-14-L3-H33-14-L1-hHS5, comprises an N-terminal FC5 nanobody domain, to facilitate passing through the blood-brain barrier, and a C-terminal anti-HSA domain to increase half-life in the body. These three formats are generally suitable for systemic administration, for example, intravenous or subcutaneous injection or infusion. The fourth entry in Table 18, H33-14-L3-H3314, is a bivalent, monospecific MVSCA with specificity only for CD33. Its smaller size makes it more suitable for local injection into the brain or eye.

The amino acid sequence of the FC5 nanobody domain is:

(SEQ ID NO: 222)
EVQLQASGGGLVQAGGSLRLSCAASGFKITHYTMGWFRQAPGKEREFVS

RITWGGDNTFYSNSVKGRFTISRDNAKNTVYLQMNSLKPEDTADYYCAA

GSTSTATPLRVDYWGKGTQVTVSS.

Example 10. Multiple Sequence Alignments

FIGS. 21-26 present multiple sequence alignments, by Clustal O (1.2.4), of the herein disclosed VHH sequences for each specificity, allowing one to readily see identical, conserved, and highly variable positions. Below each position in the alignment there is a symbol: an asterisk indicating identity, a colon indicating a higher degree of conservation, a period indicated a lower degree of conservation, and a space indicating a general absence of conservation, across the aligned sequences.

Unless otherwise indicated, all numbers expressing quantities of ingredients, properties such as molecular weight, reaction conditions, and so forth used in the specification and claims are to be understood as being modified in all instances by the term "about." As used herein the terms "about" and "approximately" means within 10 to 15%, preferably within 5 to 10%. Accordingly, unless indicated to the contrary, the numerical parameters set forth in the specification and attached claims are approximations that may vary depending upon the desired properties sought to be obtained by the present invention. At the very least, and not as an attempt to limit the application of the doctrine of equivalents to the scope of the claims, each numerical parameter should at least be construed in light of the number of reported significant digits and by applying ordinary rounding techniques. Notwithstanding that the numerical ranges and parameters setting forth the broad scope of the invention are approximations, the numerical values set forth in the specific examples are reported as precisely as possible. Any numerical value, however, inherently contains certain errors necessarily resulting from the standard deviation found in their respective testing measurements.

The terms "a," "an," "the" and similar referents used in the context of describing the invention (especially in the context of the following claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein is intended merely to better illuminate the invention and does not pose a limitation on the scope of the invention otherwise claimed. No language in the specification should be construed as indicating any non-claimed element essential to the practice of the invention.

Groupings of alternative elements or embodiments of the invention disclosed herein are not to be construed as limitations. Each group member may be referred to and claimed individually or in any combination with other members of the group or other elements found herein. It is anticipated that one or more members of a group may be included in, or deleted from, a group for reasons of convenience and/or patentability. When any such inclusion or deletion occurs, the specification is deemed to contain the group as modified thus fulfilling the written description of all Markush groups used in the appended claims.

Certain embodiments of this invention are described herein, including the best mode known to the inventors for carrying out the invention. Of course, variations on these described embodiments will become apparent to those of ordinary skill in the art upon reading the foregoing description. The inventor expects skilled artisans to employ such variations as appropriate, and the inventors intend for the invention to be practiced otherwise than specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

Specific embodiments disclosed herein may be further limited in the claims using consisting of or consisting essentially of language. When used in the claims, whether as filed or added per amendment, the transition term "consisting of" excludes any element, step, or ingredient not specified in the claims. The transition term "consisting essentially of" limits the scope of a claim to the specified materials or steps and those that do not materially affect the basic and novel characteristic(s). Embodiments of the invention so claimed are inherently or expressly described and enabled herein.

Furthermore, numerous references have been made to patents and printed publications throughout this specification. Each of the above-cited references and printed publications are individually incorporated herein by reference in their entirety.

In closing, it is to be understood that the embodiments of the invention disclosed herein are illustrative of the principles of the present invention. Other modifications that may be employed are within the scope of the invention. Thus, by way of example, but not of limitation, alternative configurations of the present invention may be utilized in accordance with the teachings herein. Accordingly, the present invention is not limited to that precisely as shown and described.

SEQUENCE LISTING (225 sequences)

SEQ ID NO: 1 - protein, 121 aa, Homo sapiens
QLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSP

SEQ ID NO: 2 - protein, 127 aa, Lama glama
QVQLVESGGGLVQAGGSLRLSCAASGYGVNSYALGWFRQAPGKEREFVAAISRSGGNINYADSAKGRFTISRDNFKNTTYLQMSSLKPEDTAVYYCAAHYLLLPSYISTSTNMYNYWGQGTQVTVSS

SEQ ID NO: 3 - protein, 127 aa, Lama glama
QVQLVESGGGLVQAGGSLRLSCAASGYGVNSYALGWFRQAPGKEREFVAAISRSGGNINYADSAKGRFTISRDNFKNTTYLQMSSLKPEDTAVYYCAAHYLLLPSYIATAIKMYNYWGQGTQVTVSS

SEQ ID NO: 4 - protein, 127 aa, Lama glama
QVQLVESGGGLVQAGGSLRLSCAASGYGVNSYALGWFRQAPGKEREFVAAISRSGGNINYADSAKGRFTISRDNFKNTTYLQMSSLKPEDTAVYYCAAHYLLLPSYISFASKMYNYWGQGTQVTVSS

SEQ ID NO: 5 - protein, 127 aa, Lama glama
QVQLVESGGGLVQAGGSLRLSCAASGGVMWSSALGWFRQAPGKEREFVAAISRSGGNINYADSAKGRFTISRDNFKNTTYLQMSSLKPEDTAVYYCAAHYLLLPSYISTSTNMYNYWGQGTQVTVSS

SEQ ID NO: 6 - protein, 127 aa, Lama glama
QVQLVESGGGLVQAGGSLRLSCAASGIRFFGSALGWFRQAPGKEREFVAAISRSGGNINYADSAKGRFTISRDNFKNTTYLQMSSLKPEDTAVYYCAAHYLLLPSYISTSTNMYNYWGQGTQVTVSS

SEQ ID NO: 7 - protein, 129 aa, Lama glama
QVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSS

SEQ ID NO: 8 - protein, 129 aa, Artificial Sequence
  humanized VHH A09-10
EVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSS

SEQ ID NO: 9 - protein, 129 aa, Artificial Sequence
  humanized hA09-10-1
QVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSS

SEQ ID NO: 10 - protein, 129 aa, Artificial Sequence
  humanized hA09-10-2
EVQLVESGGGLVQPGGSLRLSCAASGGGRTFSNYALGWFRQAPGKEREFVAAISRSGGNINYADSVKGRFTISRDNFKNTTYLQMSSLKPEDTAVYYCAAHYLLLPSYISTSTNMYNYWGQGTQVTVSS

SEQ ID NO: 11 - protein, 129 aa, Artificial Sequence
  humanized hA09-10-3
EVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSS

SEQ ID NO: 12 - protein, 129 aa, Artificial Sequence; identical to SEQ ID NO: 9
  humanized hA09-10-04

SEQ ID NO: 13 - protein, 261 aa, Artificial Sequence
  bivalent humanized hA09-10-45
EVQLVESGGGVVRPGGSLRLSCAASGGGRTFSNYAMGWFRQAPGKEREFVSAISRSGGNIYYADSVKGRFTISRDNFKNTVYLQMSSLRAEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNAKNTVYLQMSSLRAEDTAVYYCAAHYLLLPSYISTSTNMYNYWGQGTQVTVSS

SEQ ID NO: 14 - protein, 129 aa, Artificial Sequence
  humanized hA09-10-5
QVQLVESGGGLVQPGGSLRLSCAASGGGRTFSNYALGWFRQAPGKEREFVAAISRSGGNINYADSVKGRFTISRDNSKNTLYLQMSSLRAEDTAVYYCAAHYLLLPSYISTSTNMYNYWGQGTQVTVSS

SEQ ID NO: 15 - protein, 261 aa, Artificial Sequence
  bivalent humanized hA09-10-55
EVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSS

SEQ ID NO: 16 - protein, 132 aa, Artificial Sequence
  humanized hA09-10-6
AAAQVQLVESGGGLVQPGGSLRLSCAASGGGRTFSNYALGWFRQAPGKEREFVSAISRSGGNIDYADSVKGRFTISRDNAKNTVYLQMSSLRAEDTAVYYCAAHYLLLPSYISTSTNMYNYWGQGTQVTVSS

SEQ ID NO: 17 - protein, 261 aa, Artificial Sequence
  bivalent humanized hA09-10-66
EVQLVESGGGLVQPGGSLRLSCAASGGGRTFSNYALGWFRQAPGKEREFVSAISRSGGNIDYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNAKNTVYLQMSSLRAEDTAVYYCAAHYLLLPSYISTSTNMYNYWGQGTQVTVSS

SEQ ID NO: 18 - protein, 129 aa, Artificial Sequence
  humanized hA09-10-7
QVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSS

SEQ ID NO: 19 - protein, 261 aa, Artificial Sequence
  bivalent humanized hA09-10-77
EVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSS

SEQ ID NO: 20 - protein, 129 aa, Artificial Sequence
  humanized hA09-10-8
QVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSS

SEQ ID NO: 21 - protein, 261 aa, Artificial Sequence
  bivalent humanized hA09-10-88
EVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSS

SEQ ID NO: 22 - protein, 129 aa, Artificial Sequence
  humanized hA09-10-9
QVQLVESGGGLVQPGGSLRLSCAASGGGRTFSNYAMSWVRQAPGKEREFVSAISRSGGNIYYADSVKGRFTISRDNSKNTLYLQMSSLKPEDTAVYYCAAHYLLLPSYISTSTNMYNYWGQGTQVTVSS

SEQ ID NO: 23 - protein, 261 aa, Artificial Sequence
  bivalent humanized hA09-10-99
EVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSS

SEQ ID NO: 24 - protein, 129 aa, Artificial Sequence
  humanized hA09-10-10
QVQLVESGGGLVQPGGSLRLSCAASGGGRTFSNYAMSWVRQAPGKEREFVSAISRSGGNIYYADSVKGRFTISRDNSKNTLYLQMSSLRAEDTAVYYCAAHYLLLPSYISTSTNMYNYWGQGTQVTVSS

SEQ ID NO: 25 - protein, 261 aa, Artificial Sequence
  bivalent humanized hA09-10-100
EVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSS

SEQ ID NO: 26 - protein, 129 aa, Artificial Sequence
  humanized hA09-10-11
QVQLVESGGGLVQPGGSLRLSCAASGGGRTFSNYAMSWVRQAPGKEREFVSAISRSGGNIYYADSVKGRFTISRDNAKNTVYLQMSSLRAEDTAVYYCAAHYLLLPSYISTSTNMYNYWGQGTQVTVSS

SEQ ID NO: 27 - protein, 129 aa, Artificial Sequence; identical to SEQ ID NO: 22
  humanized hA09-10-12

SEQ ID NO: 28 - protein, 129 aa, Artificial Sequence
  humanized hA09-10-13
QVQLVESGGGLVQPGGSLRLSCAASGGGRTFSNYAMSWVRQAPGKEREFVSAISRSGGNIYYADSVKGRFTISRDNAKNTVYLQMSSLKPEDTAVYYCAAHYLLLPSYISTSTNMYNYWGQGTQVTVSS

SEQ ID NO: 29 - protein, 129 aa, Artificial Sequence; identical to SEQ ID NO: 24
  humanized hA09-10-14

SEQ ID NO: 30 - protein, 220 aa, Homo sapiens
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 31 - protein, 127 aa, Lama glama
QVQLVESGGGLVQAGGSLRLSCAVSGLTLSRYTMAWFRQAPGKEREFVAAIIRNSVSTFHEESVKGRFTISRDNVKNMMYLQMNTLKPEDTAVYYCATNVGPTGGFSLQSVQRYDAWGQGTQVTVSS

SEQ ID NO: 32 - protein, 123 aa, Lama glama
QVQLVESGGGLVQAGGSLRLSCAASGRTFNTYDMGWFRRAPGKEREFVAGIDWYTTNTYYADSVKGRFTISRDNAKNTVYLQMRSLKPEDTAVYYCAAGIRSTATITGQADYWGQGAQVTVSS

SEQ ID NO: 33 - protein, 114 aa, Lama glama
EVQLVESGGGLVQAGGSLRLSCAASGSTSGIYDMGWYRQAPGKLREVVGIITSGGTTNYADFAKGRFTISRDNAKNMMYLQMNSLKPEDTAVYYCNIRTRLIIWGQGTQVTVSS

SEQ ID NO: 34 - protein, 124 aa, Lama glama
QVQLVESGGGLVQAGGSLRLSCAFSGGTFLTYSLGWFRQGPGKEREFVASINWSGYMTSYVDSVKGRFTISRDNAKNTVYLQMNSLKPEDTALYYCAAARTAIAAKRSSEFDYWGQGAQVTVSS

SEQ ID NO: 35 - protein, 123 aa, Lama glama
QVQLVESGGGLVQAGGSLRLSCAASGRTFNTYDMGWFRRTPGKEREFVAGMDWNTINTYYADSVKGRFTISRDNAKNTVYLQMRSLKPEDTAVYYCAAGIRSTAIITGQADYWGQGTQVTVSS

SEQ ID NO: 36 - protein, 127 aa, Lama glama
EVQLVESGGGLVQAGGSLRLSCAASGRTFNIYSMAWFRQAPGKEREFVVRINWNRGTTYYADSVKGRFTISRDNAKNTVYLQMSNLKPEDTAVYYCAARGSPSTIGAFTSASHYDYWGQGTQVTVSS

SEQ ID NO: 37 - protein, 114 aa, Artificial Sequence
  humanized PL14
EVQLVESGGGLVQPGGSLRLSCAASGSTSGIYDMGWYRQAPGKLREVVSVITSGGTTYYADSVKGRFTISRDNSKNTLYLQMNSLRAEDTAVYYCNIRTRLIIWGQGTLVTVSS

SEQ ID NO: 38 - protein, 124 aa, Artificial Sequence
  humanized PL16
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 39 - protein, 609 aa, Homo sapiens [sequence omitted]

SEQ ID NO: 40 - protein, 122 aa, Lama glama
EVQLVESGGGLVQAGGSLRLSCAASGRAFSSYAMGWFRQAPRKEREFVATISLSGGYTYYADSVKGRFTISRDNAKNTLYLQMNSLKPEDTAVYYCAAGESSSRQDKWYDYWGQGTQVTVSS

SEQ ID NO: 41 - protein, 123 aa, Lama glama
EVQLVESGGGLVQAGGSLRLSCAASGRTFTTHAMGWFRQAPGKEREFVATINWGGRTTYYADSVKGRFIISRDTGANTVYLQMNSLKPEDTAVYYCASNLDTYNVRAGTTNSWGQGTQVTVSS

SEQ ID NO: 42 - protein, 123 aa, Lama glama
EVQLVESGGGLVQAGGSLRLSCAASGRIFHTYAVGWFRQAPGKERESVVIINWSSDHTYVAQSVKGRFTISRDRAKNTFYLQMNSLKPEDTAVYYCAVRRRLYGLRESDFDSWGQGTQVTVSS

SEQ ID NO: 43 - protein, 124 aa, Lama glama
QVQLVESGGGSVQAGGSLRLSCAASGRTFISFSMGWFRQAPGKEREFVASITNSGSGILYGDSVKGRFTISRDNAKNTMYLQMNSLKPEDTAVYYCAAGTGAGRYRYASMFDYWGQGTQVTVSS

SEQ ID NO: 44 - protein, 128 aa, Lama glama
EVQLVESGGGLVHAGGSLRLSCAASGPTFSNYFMGWFRQAPGKEREFVAAVKWSGYHTYYSDSVKGQFTISRDNAKNTVYLQMNSLKPEDTAVYYCAAGGTFSNWYTRPRSGDSYDHWGQGTQVTVSS

SEQ ID NO: 45 - protein, 124 aa, Lama glama
EVQLVESGGGLVQPGGSLRLSCAASGRTFSPYTMGWFRQASGKERESVAATTWTGSRSYYGESVKGRFTISRDSTKNTMSLQMNSLKPEDTAVYYCAAADGAGLYTNRGQYDYWGQGTQVTVSS

SEQ ID NO: 46 - protein, 123 aa, Artificial Sequence
  humanized hHS5
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSS

SEQ ID NO: 47 - protein, 125 aa, Lama glama
EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSS

SEQ ID NO: 48 - protein, 125 aa, Artificial Sequence; identical to SEQ ID NO: 47
  humanized hHS10

SEQ ID NO: 49 - protein, 242 aa, Homo sapiens
DPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVH

SEQ ID NO: 50 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANLKGASWYSANYDYWGQGTQVTVSS

SEQ ID NO: 51 - protein, 111 aa, Lama glama
QVQLVESGGGLVQAGGSLRLSCTASANILRTAPMAWYRQAPGKQREFVALITADGTTDYQESVKGRFTTSRDNAKNTVYLQMNSLQSEDTARYFCKVYSYWGQGTQVTVSS

SEQ ID NO: 52 - protein, 118 aa, Lama glama
QVQLVESGGGSVQPGGSLRLSCEASGSIFSIAHMGWYRQAPGKQRELVAVISSGGRTNYVDSVKGRFTISRDNAKNTVYLQMNSLKAEDTAVYFCNVAVVGGPRFDYWGQGTQVTVSS

SEQ ID NO: 53 - protein, 119 aa, Lama glama
EVQLMESGGGLVQAGGSLRLSCAASGRTVSTYVMGWFRQAPGKEREFVAEINRIGDTLYNRTSVKGRFTISRDNAKNTVYLQMNSLEPEDTAVYSCAARVIGTSTYNYWGQGTQVTVSS

SEQ ID NO: 54 - protein, 121 aa, Lama glama
QVQLVESGGGLVQAGGSLRLSCAASGSISSINSMNWYRQAPGKQREKVAGINSSGDTNYVDSVKGRFTISRDNAERTTYLQMNNLKPEDTGLYYCNADPRPWPNDVAFGSWGQGTRVTVSS

SEQ ID NO: 55 - protein, 117 aa, Lama glama
QVQLVESGGGLVQAGDSLKLSCAASGRTSLILAMAWWRQAPGKEREFAGRIWWNNDMTRYSDSVKGRFTISKDNTKNMVYLRMDNLGPEDTAVYYCEADLIGGSRGWGQGTQVTVSS

SEQ ID NO: 56 - protein, 123 aa, Lama glama
EVQLVESGGGLVQAGGSLRLSCLASGRTSSNSAMGWFRQAPGKEREFVGAITWNGDTTLYAYYVKDRFTISRDNAKRMVYLQMNSLKPEDTAVYYCAATDKFASSQADSYTTWGQGTQVTVSS

SEQ ID NO: 57 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKFSGASWYSAQYHSWGQGTQVTVSS

SEQ ID NO: 58 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANFNGASWFAANYHFWGQGTQVTVSS

SEQ ID NO: 59 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKLKGASWFASHYKSWGQGTQVTVSS

SEQ ID NO: 60 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANINAASWFAAKYDSWGQGTQVTVSS

SEQ ID NO: 61 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVRGSSWFSSHYDFWGQGTQVTVSS

SEQ ID NO: 62 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANLSGASWFASQYEFWGQGTQVTVSS

SEQ ID NO: 63 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVKGASWFSANYQSWGQGTQVTVSS

SEQ ID NO: 64 - protein, 123 aa, Lama glama
QVQLVESGGGLVQTGGSLRLSCVASGGTFTNYAMGWFREAPGKEREFVAGINNNGDTLYNTNSVKGRFTISRDNAKNTVYLHMNSLKLEDTAVYYCAANFKGASWFASHYQSWGQGTQVTVSS

SEQ ID NO: 65 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANFNGASWFSSNYEYWGQGTQVTVSS

SEQ ID NO: 66 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANIRGSSWFATHYDSWGQGTQVTVSS

SEQ ID NO: 67 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANLRGASWFAANYKYWGQGTQVTVSS

SEQ ID NO: 68 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKLRGASWFAANYDSWGQGTQVTVSS

SEQ ID NO: 69 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANISAASWYASQYDFWGQGTQVTVSS

SEQ ID NO: 70 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVSGASWYASHYEFWGQGTQVTVSS

SEQ ID NO: 71 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVSEASWFASKYDFWGQGTQVTVSS

SEQ ID NO: 72 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKISGASWFAAHYKSWGQGTQVTVSS

SEQ ID NO: 73 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKFRGASWFSSHYNFWGQGTQVTVSS

SEQ ID NO: 74 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVKGASWFSSNYKYWGQGTQVTVSS

SEQ ID NO: 75 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANIKASSWYSSHYNYWGQGTQVTVSS

SEQ ID NO: 76 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAANVRGASWFAAHYNSWGQGTQVTVSS

SEQ ID NO: 77 - protein, 123 aa, Lama glama
QVQLVESGGGLVQTGGSLRLSCAASGGTFTNYAMGWFREAPGKEREFVAGINNNGDTLYNTNSVKGRFTISRDNAKNTVYLHMNSLKLEDTAVYYCAAKVRAASWFAAQYKFWGQGTQVTVSS

SEQ ID NO: 78 - protein, 117 aa, Artificial Sequence
  humanized h33-14
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 79 - protein, 422 aa, Homo sapiens
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 80 - protein, 121 aa, Lama glama
QVQLVESGGGLVQPGGSLRLSCAASGTIFSINAMGWYRQAPGKQRELVAIVTFGGSTNYADSVKGRFTISRDNAKNTVYLQMNSLKPEDTAVYYCSARNVQSPVQYHLAVWGQGTLVTVSS

SEQ ID NO: 81 - protein, 118 aa, Lama glama
EVQLVESGGGLVQAGGSLRLSCAVSGSIFSISTMGWYRQAPGKQRELVASITARGSADYADSVKGRFTISRDNAKNTVYLQMSSLKPEDTAVYYCNTDTRSTLYHYSWGQGTQVTVSS

SEQ ID NO: 82 - protein, 128 aa, Lama glama
EVQLVESGGGLVQPGGSLRLSCAASGSTIDDYPIGWFRQAPGKEREGVSCIDDSDESTYYADSVKGRFTISRDNAKNTVYLQMNSLKPEDTAVYYCARGAIFMIDGVDVFLTYYYDSWGQGTQVTVSS

SEQ ID NO: 83 - protein, 128 aa, Lama glama
EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSS

SEQ ID NO: 84 - protein, 120 aa, Lama glama
QVQLVESGGGLVQPGGSLRLSCAASGFTLDYYAIGWFRQAPGKEREGVSCISSSDGSTYYADSVKGRFTISRDNAKNTVYLQMNSLKPEDTAVYYCAADRRGSCRQYDYWGQGTQVTVSS

SEQ ID NO: 85 - protein, 121 aa, Lama glama
EVQLVESGGGLVQPGGSLRLSCAASGFTLDYYAIGWFRQAPGKEREGVSCIINSDGSTYYADSVKGRFTISRDNAKNTVYLQMNSLKPEDTAVYYCATDRYSDCRGPYDYWGQGTQVTVSS

SEQ ID NO: 86 - protein, 121 aa, Lama glama
QVQLVESGGGLVQPGGSLRLSCAASGFTFGKYAMSWVRQVPDKGLEWVSSISSSGRDTSYADSAKGRFTIFRNNAANTVYLQMDNLKLEDTGVYYCVKCLEVWATREYDGWGQGTQVTVSS

SEQ ID NO: 87 - protein, 128 aa, Lama glama
QVQLVESGGGLVHPGGSLNLSCVAHGFSLDSHDMGWFRQAPGKEREVVACIKHRDGRIYILEAVKDRFVISRDNAKNTVYLEMNNLSDEDTAVYHCATASSCSDNWWLLIGDAYAGYWGQGTQVTVSS

SEQ ID NO: 88 - protein, 115 aa, Lama glama
EVQLAESGGGLVQPGGSLRLSCATSGFAFRSYVMSWVRQAPGKGLEWVSTINSDSRTSYADSVKGRFTISRDNAKNTLYLQMNSLKVEDTAVYYCSKQSPGTSQRGQGTQVTVSS

SEQ ID NO: 89 - protein, 129 aa, Lama glama
QVQLVESGGGLVQPGGSLRLSCAVSGFTSATYSIAWFRQAPGKEREGVSCISTGDGSTYYAPAVKGRFTISSDNAKNTVYLQMNGLKPEDTAVYYCAKRAGYGSAWFCPLDPSLQYDSWGQGTQVTVSS

SEQ ID NO: 90 - protein, 128 aa, Lama glama
EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGALFMIDGVDVFLTYYFEFWGQGTLVTVSS

SEQ ID NO: 91 - protein, 126 aa, Lama glama
QVQLVESGGRLVQAGGSLGLSCAASGLAFREYSMGWFRRAPGKEREFVAAVDWTGIQYYADSVKGRATISRDTAKSTVFLQMNSLNPEDTAFYYCAAGKKLTGIVLLTRRTEYDYWGQGTQVTVSS

SEQ ID NO: 92 - protein, 125 aa, Lama glama
QVQLVESGGGLVQPGGSLRLSCAHSGFTLDYYALGWFRQAPGKEREAVSCISSSDGSTYYADSVKGRFTISRDNAKNTVYLQMNSLKPEDTAVYYCASTRYGSSCRGGQWDTGSWGQGTQVTVSS

SEQ ID NO: 93 - protein, 125 aa, Lama glama
QVQLVESGGGLVQPGGSLRLSCAASGFSLDYYTIGWFRQAPGKEREAVSCINRSDGSTYYADSVKGRFTISRDNAKNTVYLQMNSLKPEDTAVYYCASTTYGTSCRGGQWDTGSWGQGTQVTVSS

SEQ ID NO: 94 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 95 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 96 - protein, 116 aa, Lama glama
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 97 - protein, 116 aa, Artificial Sequence
  humanized hCD16F1-1
EVQLVESGGGLVQPGGSLRLSCAVSGSLFSARVMSWVRQAPGKQRELVSAITSGVRTYYADSVKGRFTISRDNAKRAVYLQMNSLKPEDTAVYYCNVNLYNTGNYWGQGTQVTVSS

SEQ ID NO: 98 - protein, 116 aa, Artificial Sequence
  humanized hCD16F1-2
EVQLVESGGGLVQPGGSLRLSCAVSGSLFSARVMSWVRQAPGKQRELVSAITSGVRTYYADSVKGRFTISRDNAKRAVYLQMNSLRAEDTAVYYCNVNLYNTGNYWGQGTQVTVSS

SEQ ID NO: 99 - protein, 119 aa, Lama glama
QVQLVESGGGLVQPGGSLTLSCRASGFTFSNHAMSWVRQAPGKGLEWVSEISFNGHATRYADSLKGRFTISRDNAKNTLYLQMNTLKPEDTAVYYCRKGWNATPQIGERGRGTQVTVSS

SEQ ID NO: 100 - protein, 9 aa, Artificial Sequence
  Linker L1
GGGGSGGGS

SEQ ID NO: 101 - protein, 9 aa, Artificial Sequence
  Linker L2
  REPEAT (1)..(5): repeat = 1-35
  REPEAT (5)..(9): repeat = 0-35
GGGSSGGGS

SEQ ID NO: 102 - protein, 3 aa, Artificial Sequence
  Linker L3
AAA

SEQ ID NO: 103 - protein, 5 aa, Artificial Sequence
  Linker L4
  REPEAT (1)..(5): Repeat = 1-35
GGGGS

SEQ ID NO: 104 - protein, 18 aa, Artificial Sequence
  Linker L11*3
GGRGPLGLAGSRSAFGGS

SEQ ID NO: 105 - protein, 9 aa, Artificial Sequence
  Linker L11*4
GSPLGLAGS

SEQ ID NO: 106 - protein, 16 aa, Artificial Sequence
  Linker L11*5
GGSGPLGLAGSRSAFG

SEQ ID NO: 107 - protein, 18 aa, Artificial Sequence
  Linker L11*6
GPLGLAGSRSAGGSQVQL

SEQ ID NO: 108 - protein, 15 aa, Artificial Sequence
  Linker L11*7
GSGPLGLAARSAGGS

SEQ ID NO: 109 - protein, 16 aa, Artificial Sequence
  Linker L11*8
GSGPLGLAARSAFGGS

SEQ ID NO: 110 - protein, 21 aa, Artificial Sequence
  Linker L11*9
GGSGRSAPLGLARQARQVGGS

SEQ ID NO: 111 - protein, 19 aa, Artificial Sequence
  Linker L11*10
GGSGRSAPLGLGRQARGGS

SEQ ID NO: 112 - protein, 21 aa, Artificial Sequence
  Linker L11*11
GGSPLGLARQARGSGRSAGGS

SEQ ID NO: 113 - protein, 21 aa, Artificial Sequence
  Linker L11*12
GGSGRSAPLGLARQARVVGGS

SEQ ID NO: 114 - protein, 10 aa, Artificial Sequence
  Linker L11*13
GSRQARVVGS

SEQ ID NO: 115 - protein, 10 aa, Artificial Sequence
  Linker L11*14
GSRQRRVVGS

SEQ ID NO: 116 - protein, 8 aa, Artificial Sequence
  Linker L11*15
GSRQARGS

SEQ ID NO: 117 - protein, 8 aa, Artificial Sequence
  Linker L11*16
GSRQRRGS

SEQ ID NO: 118 - protein, 9 aa, Artificial Sequence
  Linker L11*17
GSRQARGGS

SEQ ID NO: 119 - protein, 9 aa, Artificial Sequence
  Linker L11*18
GSRQRRGGS

SEQ ID NO: 120 - protein, 401 aa, Artificial Sequence
  Trispecific antibody hHS5-L11*3-hA09-10-2-L1-hPL16
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSPLGLAGRSAFGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 121 - protein, 533 aa, Artificial Sequence
  Trispecific antibody hHS5-L11*3-hA09-10-2-L3-A09-10-L1-hPL16
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSPLGLAGRSAFGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 122 - protein, 660 aa, Artificial Sequence
  Trispecific antibody hHS5-L11*3- hA09-10-2-L3-A09-10-L1-hPL16-L3-hPL16
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSPLGLAGRSAFGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 123 - protein, 394 aa, Artificial Sequence
  Trispecific antibody hA09 -10-1-L1- hHS5-L1-hPL16
EVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 124 - protein, 526 aa, Artificial Sequence
  Trispecific antibody hA09-10-2-L3-A09-10-L1-hHS5-L1-hPL16
EVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 125 - protein, 653 aa, Artificial Sequence
  Trispecific antibody hA09-10-2-L3-A09-10-L1-hHS5-L1-hPL16-L3-hPL16
EVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 126 - protein, 521 aa, Artificial Sequence
  Trispecific antibody hA09-10-3-L1-hHS5-L1-hPL16-L3-hPL16
EVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 127 - protein, 394 aa, Artificial Sequence
  Trispecific antibody hHS5-L11*3-hA09-10-3-L1-H33-14
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSPLGLAGRSAFGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 128 - protein, 526 aa, Artificial Sequence
  Trispecific antibody hHS5-L11*3-hA09-10-2-L3-A09-10-L1-H33-14
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSPLGLAGRSAFGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 129 - protein, 639 aa, Artificial Sequence
  Trispecific antibody hHS5-L1-hA09-10-2-L3-A09-10-L1-H33-14-L3-H33-14
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 130 - protein, 646 aa, Artificial Sequence
  Trispecific antibody hHS5-L11*3-hA09-10-2-L3-A09-10-L1-H33-14-L3-H3-14
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSPLGLAGRSAFGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 131 - protein, 387 aa, Artificial Sequence
  Trispecific antibody hA09-10-3-L1-hHS5-L1-H33-14
EVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 132 - protein, 519 aa, Artificial Sequence
  Trispecific antibody hA09-10-2-L3-A09-10-L1-hHS5-L1-H33-14
EVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 133 - protein, 507 aa, Artificial Sequence
  Trispecific antibody hA09-10-L1-hHS5-L1-H33-14-L3-H33-14
EVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 134 - protein, 639 aa, Artificial Sequence
  Trispecific antibody hA09-10-2-L3-A09-10-L1-hHS5-L1-H33-14-L3-H33-14
EVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 135 - protein, 374 aa, Artificial Sequence
  Trispecific antibody H33-14-L1-hHS5-L1-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTLVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 136 - protein, 493 aa, Artificial Sequence
  Trispecific antibody H33-14-L1-hHS5-L1-CD16F1-L3-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 137 - protein, 494 aa, Artificial Sequence
  Trispecific antibody H33-14-L3-H33-14-L1-hHS5-L1-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 138 - protein, 613 aa, Artificial Sequence
  Trispecific antibody H33-14-L3-H33-14-L1-hHS5-L1-CD16F1-L3-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 139 - protein, 381 aa, Artificial Sequence
  Trispecific antibody hPL16-L1-hHS5-L1-CD16F1
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 140 - protein, 508 aa, Artificial Sequence
  Trispecific antibody hPL16-L3-hPL16-L1-hHS5-L1-CD16F1
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 141 - protein, 500 aa, Artificial Sequence
  Trispecific antibody hPL16-L1-hHS5-L1-CD16F1-L3-CD16F1
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 142 - protein, 627 aa, Artificial Sequence
  Trispecific antibody hPL16-L3-hPL16-L1-hHS5-L1-CD16F1-L3-CD16F1
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 143 - protein, 393 aa, Artificial Sequence
  Trispecific antibody hLG9-L1-hHS5-L1-hPL16 (005R)
EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 144 - protein, 524 aa, Artificial Sequence
  Trispecific antibody hLG9-L3-hLG9-L1-hHS5-L1-hPL16
EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSAAAEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 145 - protein, 520 aa, Artificial Sequence
  Trispecific antibody hLG9-L1-hHS5-L1-hPL16-L3-hPL16
EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 146 - protein, 651 aa, Artificial Sequence
  Trispecific antibody hLG9-L3-hLG9-L1-hHS5-L1-hPL16-L3-hPL16
EVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSAAAEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 147 - protein, 393 aa, Artificial Sequence
  Trispecific antibody hPL16-L1-hHS5-L1-hLG9
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSS

SEQ ID NO: 148 - protein, 524 aa, Artificial Sequence
  Trispecific antibody hPL16-L1-hHS5-L1-hLG9-L3-hLG9
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSAAAEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSS

SEQ ID NO: 149 - protein, 520 aa, Artificial Sequence
  Trispecific antibody hPL16-L3-hPL16-L1-hHS5-L1-hLG9
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSS

SEQ ID NO: 150 - protein, 651 aa, Artificial Sequence
  Trispecific antibody hPL16-L3-hPL16-L1-hHS5-L1-hLG9-L3-hLG9
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSSAAAEVQLLESGGGLVQPGGSLRLSCAASGSTIDDYPMSWFRQAPGKGREGVAAIDDSDESTYYADSVKGRFTISRDNSKNTLYLQMNSLRAEDTAVYYCARGAIFMIDGVDVFLTYYYDSWGQGTLVTVSS

SEQ ID NO: 151 - protein, 381 aa, Artificial Sequence
  Multispecific antibody hPL16-L1-hHS5-L1-CD16F1
EVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTLVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 152 - protein, 654 aa, Artificial Sequence
  Multispecific antibody CD16F1-L1-hHS10-L1- hA09-10-2-L3-A09-10-L1-hPL16 (015-3)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEEVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 153 - protein, 665 aa, Artificial Sequence
  Multispecific antibody hHS10-L11*12-CD16F1-L1-hA09-10-2-L3-A09-10-L1-hPL16
EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 154 - protein, 521 aa, Artificial Sequence
  Multispecific antibody CD16F1-L1-hHS10-L1- A09-10-L1-hPL16 (015-2)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSQVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 155 - protein, 792 aa, Artificial Sequence
  Multispecific antibody hHS10-L11*12-CD16F1-L1-hA09-10-2-L3-A09-10-L1-hPL16-L3-hPL16
EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 156 - protein, 780 aa, Artificial Sequence
  Multispecific antibody CD16F1-L1-hHS10-L1-hA09-10-2-L3-A09-10-L1-hPL16-L3-hPL16  (1511)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 157 - protein, 780 aa, Artificial Sequence
  Multispecific antibody CD16F1-L1-hHS10-L1-hA09-10-3-L3-hA09-10-4-L1-hPL16-L3-hPL16 (1518)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 158 - protein, 778 aa, Artificial Sequence
  Multispecific antibody hHS10-L11*9-CD16F1- L1-hA09-10-2-L3-A09-10-L1- H33-14-L3-H33-14
EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 159 - protein, 766 aa, Artificial Sequence
  Multispecific antibody CD16F1-L1-hHS10-L1-hA09-10-3-L3-hA09-10-4-L1-H33-14-L3-H33-14 (3321)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 160 - protein, 917 aa, Artificial Sequence
  Multipecific antibody hHS10-L11*9-CD16F1-L1-CD16F1-L1- hA09-10-2-L3-A09-10-L1- hPL-16-L3-hPL-16
EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 161 - protein, 885 aa, Artificial Sequence
  Multispecific antibody CD16F1-L3-CD16F1-L1-hHS10-L1-hA09-10-2-L3-A09-10-L1-H33-14-L3-H33 -14
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 162 - protein, 897 aa, Artificial Sequence
  Multispecific antibody hHS10-L11*12-CD16F1-L3-CD16F1-L1- hA09-10-2-L3-A09-10-L1-H33-14-L3-H33-14
EVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 163 - protein, 751 aa, Artificial Sequence
  Multispecific antibody CD16F1-L3-CD16F1-L1- hA09-10-2-L3-A09-10-L1-H33-14-L3-H33-14
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 164 - protein, 766 aa, Artificial Sequence
  Multispecific antibody H33-14-L3-H33-14-L1- hA09-10-2-L3-A09-10-L1-hHS10-L1-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 165 - protein, 885 aa, Artificial Sequence
  Multispecific antibody H33-14-L3-H33-14-L1- hA09-10-2-L3-A09-10-L1-hHS10-L1-CD16F1-L3-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 166 - protein, 778 aa, Artificial Sequence
  Multispecific antibody H33-14-L3-H33-14-L1- hA09-10-2-L3-A09-10-L1-CD16F1-L11*9-hHS10
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGSGRSAPLGLARQARQVGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSS

SEQ ID NO: 167 - protein, 897 aa, Artificial Sequence
  Multispecific antibody H33-14-L3-H33-14-L1-hA09-10-2-L3-A09-10-L1-CD16-F1-L3-CD16F1-L11* 9-hHS10
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGSGRSAPLGLARQARQVGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSS

SEQ ID NO: 168 - protein, 651 aa, Artificial Sequence
  Multispecific antibody CD16F1-L1-hHS5-L1- hA09-10-2-L3-A09-10-L1-hPL16 (015-3-HS5)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 169 - protein, 663 aa, Artificial Sequence
  Multispecific antibody hHS5-L11*9-CD16F1-L1- hA09-10-2-L3-A09-10-L1-hPL16
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 170 - protein, 526 aa, Artificial Sequence
  Multispecific antibody CD16F1-L1-hHS5-L1- A09-10-L1 -hPL16 (015-2-HS5)
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 171 - protein, 796 aa, Artificial Sequence
  Multispecific antibody hHS5-L11*9-CD16F1- L1-A09-10-L3-A0910-L1-hPL16-L3-hPL16
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 172 - protein, 778 aa, Artificial Sequence
  Multispecific antibody CD16F1-L1-hHS5-L1-A09-10-L3-A09-10-L1-hPL16-L3-hPL16
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSAKGRFTISRDNFKNTTYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 173 - protein, 778 aa, Artificial Sequence
  Multispecific antibody CD16F1-L1-hHS5-L1-hA09-10-3-L3-hA09-10-4-L1-hPL16-L3-hPL16 (1518-HS5)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 174 - protein, 776 aa, Artificial Sequence
  Multispecific antibody hHS5-L11*9-CD16F1- L1-hA09-10-2-L3-A09-10-L1- H33-14-L3-H33-14
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 175 - protein, 764 aa, Artificial Sequence
  Multispecific antibody CD16F1-L1-hHS5-L1-hA09-10-3-L3-hA09-10-4-L1-H33-14-L3-H33-14 (3211-HS5)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 176 - protein, 909 aa, Artificial Sequence
  Multispecific antibody hHS5-L11*9-CD16F1-L3-CD16F1-L1-hA09-10-2-L3-A09-10-L1-hPL-16-L3-h PL-16
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 177 - protein, 883 aa, Artificial Sequence
  Multispecific antibody CD16F1-L3-CD16F1-L1-hHS5-L1- hA09-10-2-L3-A09-10-L1-H33-14-L3-H33-14
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 178 - protein, 895 aa, Artificial Sequence
  Multispecific antibody hHS5-L11*9-CD16F1-L3-CD16F1-L1- hA09-10-2-L3-A09-10-L1-H33-14-L3-H33-14
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGSGRSAPLGLARQARQVGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 179 - protein, 764 aa, Artificial Sequence
  Multispecific antibody H33-14-L3-H33-14-L1- hA09-10-2-L3-A09-10-L1-hHS5-L1-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 180 - protein, 883 aa, Artificial Sequence
  Multispecific antibody H33-14-L3-H33-14-L1- hA09-10-2-L3-A09-10-L1-hHS5-L1-CD16F1-L3-CD16F1
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSS

SEQ ID NO: 181 - protein, 776 aa, Artificial Sequence
  Multispecific antibody H33-14-L3-H33-14-L1- hA09-10-2-L3-A09-10-L1-CD16F1-L11*9-hHS5
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGSGRSAPLGLARQARQVGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSS

SEQ ID NO: 182 - protein, 895 aa, Artificial Sequence
  Multispecific antibody H33-14-L3-H33-14- L1-hA09-10-2-L3-A09-10-L1-CD16-F1-L3-CD16F1-L11*9-hHS5
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSGGGGSGGGSEVQLVESGGGLVQPGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSAAAQVQLVESGGGLVQAGGSLRLSCAASGGGRTFSNYALGWFRQAPGKEREFVAAISRSGGNINYADSVKGRFTISRDNFKNTTYLQMSSLEPEDTAVYYCAAHYLLLPSYISTSTNMYNYWGQGTQVTVSSGGGGSGGGSEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSAAAEVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGSGRSAPLGLARQARQVGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSS

SEQ ID NO: 183 - protein, 770 aa, Artificial Sequence
  Multispecific antibody CD16F1-L1-hHS5-L4-hA09-10-3-L3-hA09-10-4-L1-H33-14-L3-H33-14 (3321-HS5-GS15)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 184 - protein, 784 aa, Artificial Sequence
  Multispecific antibody CD16F1-L1-hHS5-L1-hA09-10-3-L3-hA09-10-4-L1-hPL16-L3-hPL16 (1518-HS5-GS15)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 185 - protein, 784 aa, Artificial Sequence
  Multispecific antibody hCD16F1-1-L1-hHS5-L4-hA09-10-45- L1-hPL16-L3-hPL-16
EVQLVESGGGLVQPGGSLRLSCAASGSLFSARVMGWYRQAPGKQRELVSAITSGVRTYYADSVKGRFTISRDNAKRAVYLQMSSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNFKNTVYLQMSSLRAEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNFKNTTYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 186 - protein, 784 aa, Artificial Sequence
  Multispecific antibody hCD16F1-2-L1-hHS5-L4-hA09-10-45- L1-hPL16-L3-hPL-16
EVQLVESGGGLVQPGGSLRLSCAASGSLFSARVMGWYRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNFKNTVYLQMSSLRAEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNFKNTTYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 187 - protein, 784 aa, Artificial Sequence
  Multispecific antibody hCD16F1-1-L1-hHS5-L4-hA09-10-55-L1-hPL16-L3-hPL16
EVQLVESGGGLVQPGGSLRLSCAVSGSLFSARVMSWVRQAPGKQRELVSAITSGVRTYYADSVKGRFTISRDNAKRAVYLQMSSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 188 - protein, 784 aa, Artificial Sequence
  Multispecific antibody hCD16F1-2-L1-hHS5-L4-hA09-10-55-L1-hPL16-L3-hPl-16
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 189 - protein, 784 aa, Artificial Sequence
  Multispecific antibody hCD16F1-1-L1-hHS5-L4-hA09-10-66- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMSSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNAKNTVYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 190 - protein, 784 aa, Artificial Sequence
  Multispecific antibody hCD16F1-2-L1-hHS5-L4-hA09-10-66- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNAKNTVYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 191 - protein, 784 aa, Artificial Sequence
  Multispecific antibody hCD16F1-1-L1-hHS5-L4-hA09-10-77- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMSSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 192 - protein, 784 aa, Artificial Sequence
  Multispecific antibody hCD16F1-2-L1-hHS5-L4-hA09-10-77- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 193 - protein, 784 aa, Artificial Sequence
  Multispecific antibody hCD16F1-1-L1-hHS5-L4-hA09-10-88- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 194 - protein, 784 aa, Artificial Sequence
  Multispecific antibody hCD16F1-2-L1-hHS5-L4-hA09-10-88- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMNSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 195 - protein, 784 aa, Artificial Sequence
  Multispecific antibody hCD16F1-1-L1-hHS5-L4-hA09-10-99- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMNSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 196 - protein, 784 aa, Artificial Sequence
  Multispecific antibody hCD16F1-2-L1-hHS5-L4-hA09-10-99- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMNSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 197 - protein, 784 aa, Artificial Sequence
  Multispecific antibody hCD16F1-1-L1-hHS5-L4-hA09-10-100- L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMNSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 198 - protein, 784 aa, Artificial Sequence
  Multispecific antibody hCD16F1-2-L1-hHS5-L4-hA09-10-100-L1-hPL16-L3-hPL-16
EVQLVESGGGLVQPGGSLRLSCAVSGSLFSARVMSWVRQAPGKQRELVSAITSGVRTYYADSVKGRFTISRDNAKRAVYLQMNSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 199 - protein, 770 aa, Artificial Sequence
  Multispecific antibody CD16F1-L1-hHS5-L4-hA09-10-L3-hA09-10-L1-H33-14-L3-H33-14 (3321-HS5-GS15)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 200 - protein, 770 aa, Artificial Sequence
  Multispecific antibody hCD16F1-1-L1-hHS5-L4-hA09-10-3-L3-hA09-10-4-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 201 - protein, 770 aa, Artificial Sequence
  Multispecific antibody hCD16F1-2-L1-hHS5-L4-hA09-10-3-L3-hA09-10-4-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 202 - protein, 770 aa, Artificial Sequence
  Multispecific antibody hCD16F1-1-L1-hHS5-L4-hA09-10-45- L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNFKNTVYLQMSSLRAEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 203 - protein, 770 aa, Artificial Sequence
  Multispecific antibody hCD16F1-2-L1-hHS5-L4-hA09-10-45- L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNFKNTVYLQMSSLRAEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNFKNTTYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 204 - protein, 770 aa, Artificial Sequence
  Multispecific antibody hCD16F1-1-L1-hHS5-L4-hA09-10-55-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 205 - protein, 770 aa, Artificial Sequence
  Multispecific antibody hCD16F1-2-L1-hHS5-L4-hA09-10-55- L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSAAAQVQLVESGGGVVRPGGSLRLSCAASGGGRTFSNYAMGWFRQAPGKEREFVSAISRSGGNIYYADSVKGRFTISRDNSKNTLYLQMSSLEPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 206 - protein, 770 aa, Artificial Sequence
  Multispecific antibody hCD16F1-1-L1-hHS5-L4-hA09-10-77- L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 207 - protein, 770 aa, Artificial Sequence
  Multispecific antibody hCD16F1-2-L1-hHS5-L4-hA09-10-77- L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIDYADSVKGRFTISRDNSKNTLYLQMSSLKPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 208 - protein, 770 aa, Artificial Sequence
  Multispecific antibody hCD16F1-1-L1-hHS5-L1-hA09-10-66-L1 -H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 209 - protein, 770 aa, Artificial Sequence
  Multispecific antibody hCD16F1-2-L1-hHS5-L4-hA09-10-66-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMSSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIDYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 210 - protein, 770 aa, Artificial Sequence
  Multispecific antibody hCD16F1-1-L1-hHS5-L4-hA09-10-88-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMNSLKPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 211 - protein, 770 aa, Artificial Sequence
  Multispecific antibody hCD16F1-2-L1-hHS5-L4-hA09-10-88-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMNSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYALGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 212 - protein, 770 aa, Artificial Sequence
  Multispecific antibody hCD16F1-1-L1-hHS5-L4-hA09-10-99-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMNSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 213 - protein, 770 aa, Artificial Sequence
  Multispecific antibody hCD16F1-2-L1-hHS5-L4-hA09-10-99-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMNSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLKPEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 214 - protein, 770 aa, Artificial Sequence
  Multispecific antibody hCD16F1-1-L1-hHS5-L4-hA09-10-100-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMNSLEPEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 215 - protein, 770 aa, Artificial Sequence
  Multispecific antibody hCD16F1-2-L1-hHS5-L4-hA09-10-100-L1-H33-14-L3-H33-14
EVQLVESGGGLVQPGGSLRLSCAVSGSLFSARVMSWVRQAPGKQRELVSAITSGVRTYYADSVKGRFTISRDNAKRAVYLQMNSLRAEDTAVYYCNVNLYNTGNYWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGGSGGGGSEVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSAAAQVQLVESGGGLVQPGGSLRLSCAASGGGRTFSNYAMGWFRQAPGKEREFVSAISRSGGNIYYADSVKGRFTISRDNSKNTLYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 216 - protein, 772 aa, Artificial Sequence
  Multispecific antibody CD16F1-L1-hHS10-L4-hA09-10-3-L3-hA09-10-4-L1-H33-14-L3-H33-14 (3321-GS15)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGGSGGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTLVTVSS

SEQ ID NO: 217 - protein, 786 aa, Artificial Sequence
  Multispecific antibody CD16F1-L1-hHS10-L4-hA09-10-3-L3-hA09-10-4-L1-hPL16-L3-hPL16 (1518-GS15)
EVQLVESGGGLVQPGGSLRLSCAVSGSLFSARVMGWYRQAPGKQRELVAAITSGVRTDYADSVKGRFTISRDNAKRAVYLQMNSLKPEDTAVYYCNVNLYNTGNYWGQGTQVTVSSGGGGSGGGSEVQLVESGGGLVQPGGSLRLSCAASGSTDSAYRMGWFRQAPGKEREFVSAINWSDGRTYYADSVKGRFTISRDNSKNTLYLQMNSLRAEDTAVYYCAADPDSRLYYTVPQNYDYWGQGTLVTVSSGGGGSGGGGSGGGGSEVQLVESGGGLVQPGGSLRLSCAASGGGRTFSNYALGWFRQAPGKEREFVAAISRSGGNINYADSVKGRFTISRDNFKNTVYLQMSSLRAEDTAVYYCAAHYLLLPSYISTSTNMYNYWGQGTQVTVSSAAAQVQLVESGGGLVQPGGSLRLSCAASGGGRTFSNYALGWFRQAPGKEREFVAAISRSGGNINYADSVKGRFTISRDNAKNTVYLQMSSLRAEDTAVYYCAAHYLLLPSYISTSTNMYNYWGQGTQVTVSSGGGGSGGGSEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSSAAAEVQLVESGGGLVQPGGSLRLSCAASGGTFLTYSMSWVRQAPGKEREFVSSINWSGYMTYYADSVKGRFTISRDNSKNTLYLQMNSLRAEDTAVYYCAAARTAIAAKRSSEFDYWGQGTQVTVSS

SEQ ID NO: 218 - protein, 375 aa, Artificial Sequence
  Multispecific antibody hHS5-L1-H33-14-L3-H33-14**
EVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSHHHHHH

SEQ ID NO: 219 - protein, 368 aa, Artificial Sequence
  Multispecific antibody FC5-L1-H33-14-L3-H33-14
EVQLQASGGGLVQAGGSLRLSCAASGFKITHYTMGWFRQAPGKEREFVSRITWGGDNTFYSNSVKGRFTISRDNAKNTVYLQMNSLKPEDTADYYCAAGSTSTATPLRVDYWGKGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 220 - protein, 500 aa, Artificial Sequence
  Multispecific antibody FC5-L1-H33-14-L3-H33-14-L1-hHS5
EVQLQASGGGLVQAGGSLRLSCAASGFKITHYTMGWFRQAPGKEREFVSRITWGGDNTFYSNSVKGRFTISRDNAKNTVYLQMNSLKPEDTADYYCAAGSTSTATPLRVDYWGKGTQVTVSSGGGGSGGGSQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSGGGGSGGGSEVQLLESGGGLVQPGGSLRLSCAASGRTFTTHAMGWFRQAPGKEREFVSAINWGGRTTYYADSVKGRFIISRDTGANTLYLQMNSLRAEDTAVYYCASNLDTYNVRAGTTNSWGQGTQVTVSS

SEQ ID NO: 221 - protein, 237 aa, Artificial Sequence
  Multispecific antibody H33-14-L3-H33-14
QVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSSAAAQVQLVESGGGLVQPGGSLRLSCAASGRTSLILAMAWWRQAPGKEREFAGRIWWNNDMTRYSDSVKGRFTISRDNAKNTVYLQMSSLRAEDTAVYYCEADLIGGSRGWGQGTQVTVSS

SEQ ID NO: 222 - protein, 122 aa, Artificial Sequence
  FC5 nanobody
EVQLQASGGGLVQAGGSLRLSCAASGFKITHYTMGWFRQAPGKEREFVSRITWGGDNTFYSNSVKGRFTISRDNAKNTVYLQMNSLKPEDTADYYCAAGSTSTATPLRVDYWGKGTQVTVSS

SEQ ID NO: 223 - protein, 129 aa, Artificial Sequence
  humanized hA09-10-30
EVQLVESGGGLVQPGGSLRLSCAASGGGRTFSNYALGWFRQAPGKEREFVAAISRSGGNINYADSVKGRFTISRDNAKNTVYLQMSSLEPEDTAVYYCAAHYLLLPSYISTSTNMYNYWGQGTQVTVSS

SEQ ID NO: 224 - protein, 6 aa, Artificial Sequence
  Linker
EPKSCD

SEQ ID NO: 225 - protein, 6 aa, Artificial Sequence
  Linker
ASTKGP

What is claimed is:

1. A variable heavy (VHH) domain having an antigen-binding specificity for one of:
- (a) human CD47, wherein the VHH domain has the amino acid sequence of one of SEQ ID NOs: 2-29 or 223;
- (b) human PD-L1, wherein the VHH region has the amino acid sequence of one of SEQ ID NOs: 31-38;
- (c) human serum albumin (HSA), wherein the VHH domain has the amino acid sequence of one of SEQ ID NOs: 40-48;
- (d) human CD33, wherein the VHH domain has the amino acid sequence of one of SEQ ID NOs: 50-78;
- (e) human LAG3, wherein the VHH domain has the amino acid sequence of one of SEQ ID NOs: 80-93; or
- (f) human CD16 comprising, wherein the VHH domain has the amino acid sequence of one of SEQ ID NOs: 96-99.

2. A multi-specific antibody comprising an antibody binding domain with first binding specificity and a second antibody binding domain with a second binding specificity that is different than the first binding specificity wherein the first binding specificity is specific for human CD47, human PD-L1, HSA, human CD33, human LAG3, or human CD16; wherein
- (a) the human CD47 binding specificity is represented by the amino acid sequence of one of SEQ ID NOs: 2-29 or 223;
- (b) the human PD-L1 binding specificity is represented by the amino acid sequence of one of SEQ ID NOs: 31-38;
- (c) the HSA binding specificity is represented by the amino acid sequence of one of SEQ ID NOs: 40-48;
- (d) the human CD33 binding specificity is represented by the amino acid sequence of one of SEQ ID NOs: 50-78;
- (e) the human LAG3 binding specificity is represented by the amino acid sequence of one of SEQ ID NOs: 80-93; and
- (f) the human CD16 binding specificity is represented by the amino acid sequence of one of SEQ ID NOs: 96-99.

3. The multi-specific antibody of claim 2, wherein the second antibody binding domain is specific for human CD47, human PD-L1, HSA, human CD33, human LAG3, or human CD16; wherein
- (a) the human CD47 binding specificity is represented by the amino acid sequence of one of SEQ ID NOs: 2-29 or 223;
- (b) the human PD-L1 binding specificity is represented by the amino acid sequence of one of SEQ ID NOs: 31-38;
- (c) the HSA binding specificity is represented by the amino acid sequence of one of SEQ ID NOs: 40-48;
- (d) the human CD33 binding specificity is represented by the amino acid sequence of one of SEQ ID NOs: 50-78;
- (e) the human LAG3 binding specificity is represented by the amino acid sequence of one of SEQ ID NOs: 80-93; and
- (f) the human CD16 binding specificity is represented by the amino acid sequence of one of SEQ ID NOs: 96-99.

4. The multi-specific antibody of claim 2, further comprising one to five additional antibody binding domains, wherein each additional antibody binding domain is individually specific for human CD47, human PD-L1, HSA, human CD33, human LAG3, or human CD16; wherein (a) the human CD47 binding specificity is represented by the amino acid sequence of one of SEQ ID NOs: 2-29 or 223;

(b) the human PD-L1 binding specificity is represented by the amino acid sequence of one of SEQ ID NOs: 31-38;

(c) the HSA binding specificity is represented by the amino acid sequence of one of SEQ ID NOs: 40-48;

(d) the human CD33 binding specificity is represented by the amino acid sequence of one of SEQ ID NOs: 50-78;

(e) the human LAG3 binding specificity is represented by the amino acid sequence of one of SEQ ID NOs: 80-93; and (f) the human CD16 binding specificity is represented by the amino acid sequence of one of SEQ ID NOs: 96-99.

5. The multi-specific antibody of claim 4, further comprising one to four additional antibody binding domains, wherein each additional antibody binding domain is specific for human CD47, human PD-L1, HSA, human CD33, human LAG3, or human CD16; wherein (a) the human CD47 binding specificity is represented by the amino acid sequence of one of SEQ ID NOs: 2-29 or 223;

(b) the human PD-L1 binding specificity is represented by the amino acid sequence of one of SEQ ID NOs: 31-38;

(c) the HSA binding specificity is represented by the amino acid sequence of one of SEQ ID NOs: 40-48;

(d) the human CD33 binding specificity is represented by the amino acid sequence of one of SEQ ID NOs: 50-78;

(e) the human LAG3 binding specificity is represented by the amino acid sequence of one of SEQ ID NOs: 80-93; and (f) the human CD16 binding specificity is represented by the amino acid sequence of one of SEQ ID NOs: 96-99.

6. The multi-specific antibody of claim 2, wherein the antibody is a multi-specific single chain antibody (MVSCA).

7. The multi-specific antibody of claim 2, wherein linker L1 (SEQ ID NO:100), L2 (SEQ ID NO:101), or L4 (SEQ ID NO: 103) is interposed between one or more pairs of non-identical antibody binding domains.

8. The multi-specific antibody of claim 4, comprising at least one pair of antibody binding domains with the same specificity.

9. The multi-specific antibody of claim 8, wherein the at least one pair of antibody binding domains with the same specificity are adjacent to each other and have linker L3 (SEQ ID NO: 102) interposed between them.

10. The multi-specific antibody of claim 2, comprising an N- or C-terminally positioned antibody binding domain specific for HSA with a cleavable linker interposed between it and the antibody binding domain adjacent to it.

11. The multi-specific antibody of claim 10, wherein the cleavable linker is L11*3 (SEQ ID NO:104), L11*4 (SEQ ID NO: 105), L11*5 (SEQ ID NO: 106), L11*6 (SEQ ID NO: 107), L11*7 (SEQ ID NO: 108), L11*8 (SEQ ID NO:109), L11*9 (SEQ ID NO:110), L11*10 (SEQ ID NO:111), L11*11 (SEQ ID NO:112), L11*12 (SEQ ID NO:113), L11*13 (SEQ ID NO:114), L11*14 (SEQ ID NO:115), L11*15 (SEQ ID NO:116), L11*16 (SEQ ID NO: 117), L11*17 (SEQ ID NO: 118), or L11*18 (SEQ ID NO:119).

12. The multi-specific antibody of claim 2, wherein all of the antibody binding domains are VHH domains.

13. The multi-specific antibody of claim 2, comprising antibody binding domains recognizing:

(a) HSA, human CD47, and human PD-L1;

(b) HSA, human CD47, and human CD33;

(c) HSA, human LAG3, and human PD-L1;

(d) HSA, human LAG3, and human CD33;

(e) human CD16, HSA, and human PD-L1;

(f) human CD16, HSA, and human CD33;

(g) human CD16, HSA, and human CD47;

(h) human CD16, HSA, human CD47, and human PD-L1; or (i) human CD16, HSA, human CD47, and human CD33.

14. The multi-specific antibody of claim 13, wherein the multispecific antibody comprises the antibody binding domains recognizing human CD16, HSA, human CD47 and a fourth antibody binding domain recognizing human PD-L1, human CD33, or human LAG3.

15. A pharmaceutical composition comprising the multi-specific antibody of claim 2.

16. A method of inhibiting tumor growth in a patient with cancer comprising administering the pharmaceutical composition of claim 15 to the patient, wherein the multi-specific antibody of the pharmaceutical composition is SEQ ID NO: 156, SEQ ID NO: 157, or SEQ ID NO: 159.

* * * * *